United States Patent
Sella-Tavor et al.

(10) Patent No.: US 9,347,952 B2
(45) Date of Patent: May 24, 2016

(54) SOLUBLE VEGFR-1 VARIANTS FOR DIAGNOSIS OF PREECLAMPSIA

(71) Applicant: Compugen Ltd., Tel Aviv (IL)

(72) Inventors: Osnat Sella-Tavor, Kfar Kish (IL); Sarah Pollock, Tel-Aviv (IL); Gad S. Cojocaru, Ramat-Hasharon (IL); Amit Novik, Tel-Mond (IL); Lily Bazak, Givatayim (IL); Elena Tsypkin, Tel-Aviv (IL); Shira Wallach, Hod Hasharon (IL); Shirley Sameah-Greenwald, Kfar Saba (IL)

(73) Assignee: Compugen Ltd., Tel Aviv (IL)

( * ) Notice: Subject to any disclaimer, the term of this patent is extended or adjusted under 35 U.S.C. 154(b) by 0 days.

(21) Appl. No.: 14/594,772

(22) Filed: Jan. 12, 2015

(65) Prior Publication Data

US 2015/0132318 A1 May 14, 2015

Related U.S. Application Data

(63) Continuation of application No. 12/089,051, filed as application No. PCT/IL2006/001154 on Oct. 3, 2006, now abandoned.

(60) Provisional application No. 60/742,929, filed on Dec. 6, 2005, provisional application No. 60/735,825, filed on Nov. 14, 2005, provisional application No. 60/722,400, filed on Oct. 3, 2005.

(30) Foreign Application Priority Data

Nov. 30, 2005 (IL) .......................................... 172297

(51) Int. Cl.
*G01N 33/68* (2006.01)
*C07K 14/47* (2006.01)
*G01N 33/574* (2006.01)

(52) U.S. Cl.
CPC .............. *G01N 33/689* (2013.01); *C07K 14/47* (2013.01); *G01N 33/574* (2013.01); *G01N 33/6893* (2013.01); *G01N 2800/52* (2013.01)

(58) Field of Classification Search
None
See application file for complete search history.

(56) References Cited

U.S. PATENT DOCUMENTS

| 5,952,199 | A  | 9/1999  | Davis-Smyth   |
| 6,625,545 | B1 | 9/2003  | Amitai        |
| 7,939,634 | B2 | 5/2011  | Ayalon-Soffer |
| 2004/0101876 | A1 | 5/2004 | Mintz        |
| 2004/0126767 | A1 | 7/2004 | Anderberg    |
| 2006/0234347 | A1 | 10/2006 | Harding     |
| 2010/0075891 | A1 | 3/2010 | Ayalon-Soffer |

FOREIGN PATENT DOCUMENTS

| WO | 01/64835     | 9/2001 |
| WO | 02/060950    | 8/2002 |
| WO | 2005/016966  | 2/2005 |
| WO | 2005/020972  | 3/2005 |
| WO | 2005/072340  | 8/2005 |
| WO | 2006/043271  | 4/2006 |
| WO | 2006/054297  | 5/2006 |
| WO | 2006/072954  | 7/2006 |

OTHER PUBLICATIONS

Thomas et al., FASEB J. 2007; 21: 3885-3895.*
Boguski et al., (1993) dbEST—database for "expressed sequence tags". Nat Genet 4(4): 332-3.
Costa et al., "Angiogenesis and chronic inflammation: cause or consequence?", Angiogenesis 2007; 10: 149-66.
Edgar et al., (2002) Gene Expression Omnibus: NCBI gene expression and hybridization array data repository. Nucleic Acids Res 30(1): 207-10.
Gabhann and Popel (2004) Model of competitive binding of vascular endothelial growth factor and placental growth factor to VEGF receptors on endothelial cells. Am J Physiol Heart Circ Physiol 286: H153-H164.
Hazkani-Covo et al., (2004) Evolution of multicellularity in Metazoa: comparative analysis of the subcellular localization of proteins in Saccharomyces, Drosophila and Caenorhabditis. Cell Biol Int 28(3): 171-8.
Koga et al., (2003) Elevated Serum Soluble Vascular Endothelial Growth Factor Receptor 1 (sVEGFR-1) Levels in Women with Preeclampsia. J Clin Endocrinol Metabo 88: 2348-51.
Levine et al., (2004) Circulating Angiogenic Factors and the Risk of Preeclampsia. N Engl J Med 350: 672-83.
Miotla et al., (2000) Treatment with Soluble VEGF Receptor Reduces Disease Severity in Murine Collagen-Induced Arthritis. Lab Invest 80: 1195-1205.
Park et al.,(2005) an elevated maternal plasma, but not amniotic fluid, soluble fms-like tyrosine kinase-1 (sFlt-1) at the time of mid-trimester genetic amniocentesis is a risk factor for preeclampsia. Am J Obstetrics Gynnecol 193: 984-9.
Sorek et al., (2002) Alu-containing exons are alternatively spliced. Genome Res 12(7): 1060-7.
Sorek and Safer (2003) A novel algorithm for computational identification of contaminated EST libraries. Nucleic Acids Res 31(3): 1067-74.
Su et al., (2004) A gene atlas of the mouse and human protein-encoding transcriptomes. Proc Natl Acad Sci U S A 101 (16): 6062-7.
Wagner et al., (2007) Hypertensive pregnancy disorders: current concepts. J Clin Hypertens (Greenwich 9(7): 560-6.
GenBank Accession No: DQ143945 GI: 71648775 Aug. 7, 2005.
R&D catalogue, sVEGFR1 ELISA kit; downloaded May 25, 2011 from rndsystems.com/pdf/DVR100B.pdf; 16 pages total.
Pufe et al., (2001) Splice variants VEGF121 and VEGF165 of the angiogenic peptide vascular endothelial cell growth factor are expressed in the synovial tissue of patients with rheumatoid arthritis. J Rheumatol 28(7): 1482-5.
Valter et al., (1999) Expression of the Ets-1 transcription factor in human astrocytomas is associated with Fms-like tyrosine kinase-1 (Flt-1)/vascular endothelial growth factor receptor-1 synthesis and neoangiogenesis. Cancer Res 59 (21): 5608-14.

* cited by examiner

*Primary Examiner* — Christina Borgeest
(74) *Attorney, Agent, or Firm* — Rodney J. Fuller; Booth Udall Fuller, PLC

(57) ABSTRACT

Novel splice variants, amino acid sequences and nucleotide sequences thereof, and methods of using same.

2 Claims, 73 Drawing Sheets

SOLUBLE VEGFR-1 VARIANTS FOR DIAGNOSIS OF PREECLAMPSIA

CROSS-REFERENCE TO RELATED APPLICATIONS

This application is a continuation of U.S. patent application Ser. No. 12/089,051, filed Apr. 2, 2008, which is a U.S. National Stage of International Application No. PCT/IL2006/001154 filed Oct. 3, 2006, which is based on and claims the benefit of U.S. Provisional Application Nos. 60/742,929, filed Dec. 6, 2005; 60/735,825 filed Nov. 14, 2005; and 60/722,400 filed Oct. 3, 2005, and claims the benefit of and priority to Israeli Application No. 172297 filed Nov. 30, 2005, the contents of each of which are expressly incorporated herein in their entireties.

INCORPORATION-BY-REFERENCE OF MATERIAL ELECTRONICALLY FILED

Incorporated by reference in its entirety herein is a computer-readable nucleotide/amino acid sequence listing submitted concurrently herewith and identified as follows: One 634,813 kilobyte ASCII (text) file named "Seq_List" created on Jan. 12, 2015.

FIELD OF THE INVENTION

The present invention is related to novel nucleotide and protein sequences, and assays and methods of use thereof.

BACKGROUND OF THE INVENTION

Diagnostic markers are important for early diagnosis of many diseases, as well as predicting response to treatment, monitoring treatment and determining prognosis of such diseases.

Serum markers are examples of such diagnostic markers and are used for diagnosis of many different diseases. Such serum markers typically encompass secreted proteins and/or peptides; however, some serum markers may be released to the blood upon tissue lysis, such as from myocardial infarction (for example Troponin-I). Serum markers can also be used as risk factors for disease (for example base-line levels of CRP, as a predictor of cardiovascular disease), to monitor disease activity and progression (for example, determination of CRP levels to monitor acute phase inflammatory response) and to predict and monitor drug response (for example, as shedded fragments of the protein Erb-B2).

Immunohistochemistry (IHC) is the study of distribution of an antigen of choice in a sample based on specific antibody-antigen binding, typically on tissue slices. The antibody features a label which can be detected, for example as a stain which is detectable under a microscope. The tissue slices are prepared by being fixed. IHC is therefore particularly suitable for antibody-antigen reactions that are not disturbed or destroyed by the process of tissue fixation.

IHC permits determining the localization of binding, and hence mapping of the presence of the antigen within the tissue and even within different compartments in the cell. Such mapping can provide useful diagnostic information, including:
1) the histological type of the tissue sample
2) the presence of specific cell types within the sample
3) information on the physiological and/or pathological state of cells (e.g. which phase of the cell-cycle they are in)
4) the presence of disease related changes within the sample
5) differentiation between different specific disease subtypes where it is already known the tissue is of disease state (for example, the differentiation between different tumor types when it is already known the sample was taken from cancerous tissue).

IHC information is valuable for more than diagnosis. It can also be used to determine prognosis and therapy treatment (as in the case of HER-2 in breast cancer) and monitor disease.

IHC protein markers could be from any cellular location. Most often these markers are membrane proteins but secreted proteins or intracellular proteins (including intranuclear) can be used as an IHC marker too.

IHC has at least two major disadvantages. It is performed on tissue samples and therefore a tissue sample has to be collected from the patient, which most often requires invasive procedures like biopsy associated with pain, discomfort, hospitalization and risk of infection. In addition, the interpretation of the result is observer dependant and therefore subjective. There is no measured value but rather only an estimation (on a scale of 1-4) of how prevalent the antigen on target is.

SUMMARY OF THE INVENTION

The present invention provides, in different embodiments, many novel amino acid and nucleic acid sequences, which may optionally be used as diagnostic markers.

In some embodiments, the present invention provides a number of different variants of known proteins, which are expressed in serum and may optionally be used as diagnostic markers, which in some embodiments, are serum markers, or in other embodiments, are IHC markers. The present invention therefore overcomes the many deficiencies of the background art with regard to the need to obtain tissue samples and subjective interpretations of results. In one embodiment, tissue specific markers are identifible in serum or plasma. In some embodiments, a simple blood test can provide qualitative and/or quantitative indicators for expression of a desired marker, for example, serving as an indicator for various diseases and/or pathological conditions. The markers presented in the present invention can also potentially be used for in-vivo imaging applications.

The present invention also provides, in some embodiments, a number of different variants, which serve as IHC markers or indicators, which in some embodiments, serve as diagnostic markers, for example as serum markers, or IHC markers. [The present invention therefore overcomes the many deficiencies of the background art with regard to the need to obtain tissue samples and subjective interpretations of results. For example, serum markers require only a simple blood test and their result is typically a scientifically measured number. As IHC markers, the variants of the present invention may also provide different and/or better measurement parameters for various diseases and/or pathological conditions.

Other variants are also provided by the present invention as described in greater detail below.

The diseases for which such variants may be useful as diagnostic markers are described in greater detail below. The variants themselves are described by "cluster" or by gene, as these variants are splice variants of known proteins. In some embodiments, the term "marker-detectable disease" refers to a disease that may be detected by a particular marker, with regard to the description of such diseases below. In some embodiments, the markers of the present invention, alone or in combination, show a high degree of differential detection between disease and non-disease states.

The present invention relates, in some embodiments, to diagnostic assays for disease detection, which in some embodiments, utilizes a biological sample taken from a subject (patient), which for example may comprise a body fluid or secretion including but not limited to seminal plasma, blood, serum, urine, prostatic fluid, seminal fluid, semen, the external secretions of the skin, respiratory, intestinal, and genitourinary tracts, tears, cerebrospinal fluid, sputum, saliva, milk, peritoneal fluid, pleural fluid, cyst fluid, secretions of the breast ductal system (and/or lavage thereof), broncho alveolar lavage, lavage of the reproductive system, lavage of any other part of the body or system in the body, stool or a tissue sample, or any combination thereof. In some embodiments, the term encompasses samples of in vivo cell culture constituents. The sample can optionally be diluted with a suitable eluant before contacting the sample to an antibody and/or performing any other diagnostic assay.

In some embodiments of the present invention, nucleic acids, or polypeptides, having a sequence as described herein, or homologues thereof.

In some embodiments, the terms "homology", "homologue" or "homologous", in any instance, indicate that the sequence referred to, whether an amino acid sequence, or a nucleic acid sequence, exhibits, in one embodiment at least 70% correspondence with the indicated sequence. In another embodiment, the amino acid sequence or nucleic acid sequence exhibits at least 72% correspondence with the indicated sequence. In another embodiment, the amino acid sequence or nucleic acid sequence exhibits at least 75% correspondence with the indicated sequence. In another embodiment, the amino acid sequence or nucleic acid sequence exhibits at least 77% correspondence with the indicated sequence. In another embodiment, the amino acid sequence or nucleic acid sequence exhibits at least 80% correspondence with the indicated sequence. In another embodiment, the amino acid sequence or nucleic acid sequence exhibits at least 82% correspondence with the indicated sequence. In another embodiment, the amino acid sequence or nucleic acid sequence exhibits at least 85% correspondence with the indicated sequence. In another embodiment, the amino acid sequence or nucleic acid sequence exhibits at least 87% correspondence with the indicated sequence. In another embodiment, the amino acid sequence or nucleic acid sequence exhibits at least 90% correspondence with the indicated sequence. In another embodiment, the amino acid sequence or nucleic acid sequence exhibits at least 92% correspondence with the indicated sequence. In another embodiment, the amino acid sequence or nucleic acid sequence exhibits at least 95% or more correspondence with the indicated sequence. In another embodiment, the amino acid sequence or nucleic acid sequence exhibits 95%-100% correspondence to the indicated sequence. Similarly, in some embodiments, the reference to a correspondence to a particular sequence includes both direct correspondence, as well as homology to that sequence as herein defined.

In some embodiments, this invention provides an isolated polynucleotide comprising a nucleic acid having a sequence corresponding to, or homologous to that set forth in SEQ ID NOs: 1-15, 61-64, 96-98, 114-126, 189-195, 211-214, 235, 244, 152-253, 305-306, 340-344.

In some embodiments, this invention provides an isolated polynucleotide comprising a nucleic acid having a sequence corresponding to, or homologous to that set forth in SEQ ID NOs: 32-60, 71-95, 103-113, 139-188, 196-219, 220-234, 237-243, 246-251, 256-304, 309-339, 350-358, 502-530.

In some embodiments, this invention provides an isolated protein or polypeptide having an amino acid sequence corresponding to, or homologous to that set forth in SEQ ID NOs:16-31, 65-70, 99-102, 127-138, 215-219, 236, 245, 254-255, 307-308.

In some embodiments, the proteins or polypeptides of this invention comprise chimeric protein or polypeptides.

In some embodiments, the terms "chimeric protein or polypeptide", or "chimera" refers to an assembly or a string of amino acids in a particular sequence, or nucleotides encoding the same, respectively, which does not correspond to the sequence of the known (wild type) polypeptide or protein, or nucleic acid, respectively. In some embodiments, the variants of this invention are derived by the by the assembly or stringing of amino acids or polynucleotides encoding the same, from two exons, or an exon and an intron, or fragments thereof, or segments having sequences with the indicated homology.

In some embodiments, the isolated chimeric proteins or polypeptides of the invention may comprise an amino acid sequence corresponding to or homologous to that set forth in SEQ ID NO:16 (HSFLT_P6).

In some embodiments, such isolated chimeric proteins or polypeptides may comprise an amino acid sequence corresponding to or homologous to that set forth in HSFLT_P6 (SEQ ID NO:16), comprising a first amino acid sequence being at least 70%, optionally at least 80%, preferably at least 85%, more preferably at least 90% and most preferably at least 95%, homologous to a polypeptide having the sequence MTAP (SEQ ID NO: 459) corresponding to amino acids 1-4 of HSFLT_P6 (SEQ ID NO:16), and a second amino acid sequence being at least 90% homologous to amino acids 172-1338 of VGR1_HUMAN_V1 (SEQ ID NO: 575), which also corresponds to amino acids 5-1171 of HSFLT_P6 (SEQ ID NO:16), wherein said first amino acid sequence and second amino acid sequence are contiguous and in a sequential order.

In some embodiments, this invention provides an isolated polypeptide comprising a head portion of an HSFLT_P6 (SEQ ID NO:16), comprising a polypeptide being at least 70%, optionally at least about 80%, preferably at least about 85%, more preferably at least about 90% and most preferably at least about 95% homologous to the sequence MTAP (SEQ ID NO: 459) of HSFLT_P6 (SEQ ID NO:16).

In some embodiments, such isolated chimeric proteins or polypeptides may comprise an amino acid sequence corresponding to or homologous to that as set forth in HSFLT_P6 (SEQ ID NO:16), comprising a first amino acid sequence being at least 70%, optionally at least 80%, preferably at least 85%, more preferably at least 90% and most preferably at least 95%, homologous to a polypeptide having the sequence MTAP (SEQ ID NO: 459) corresponding to amino acids 1-4 of HSFLT_P6 (SEQ ID NO:16), a second amino acid sequence being at least 90% homologous to amino acids 172-656 of P17948-2 (SEQ ID NO:360), which also corresponds to amino acids 5-489 of HSFLT_P6 (SEQ ID NO:16), and a third amino acid sequence being at least 70%, optionally at least 80%, preferably at least 85%, more preferably at least 90% and most preferably at least 95% homologous to a polypeptide having the sequence DQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDE QCERLPYDASKWEFARERLKLGKSLGRGAFGKVVQASAFGIKKSPTCRTVAVKMLKEGATASEYKALMTELK ILTHIGHHLNVVNLLGACTKQGGPLMVIVEYCKYGNLSNYLKSKRDLFFLNKDAALHMEPKKEKMEPGLEQG KKPRLDSVTSSESFASSG- FQEDKSLSDVEEEEDSDGFYKEPITMEDLISYSFQVA-RGMEFLSSRKCIHRDLAARNI LLSENNVVKICDF-GLARDIYKNPDYVRKGDTRLPLKWMAPESIFDKIY-STKSDVWSYGVLLWEIFSLGGSPYPG VQMDEDFCS-RLREGMRMRAPEYSTPEIYQIMLDCWHRDPKERP-RFAELVEKLGDLLQANVQQDGKDYIPINAI LTGNSG-FTYSTPAFSEDFFKESISAPKFNSGSSDDVRYVNAF-KFMSLERIKTFEELLPNATSMFDDYQGDSSTLL ASP-MLKRFTWTDSKPKASLKIDLRVTSKSKESGLSDV-SRPSFCHSSCGHVSEGKRRFTYDHAELERKIA-CCSPPP DYNSVVLYSTPPI (SEQ ID NO: 460) corresponding to amino acids 490-1171 of HSFLT_P6 (SEQ ID NO:16), wherein said first amino acid sequence, second amino acid sequence and third amino acid sequence are contiguous and in a sequential order.

In some embodiments, this invention provides an isolated polypeptide encoding for a head of HSFLT_P6 (SEQ ID NO:16), comprising a polypeptide being at least 70%, optionally at least about 80%, preferably at least about 85%, more preferably at least about 90% and most preferably at least about 95% homologous to the sequence MTAP (SEQ ID NO: 459) of HSFLT_P6 (SEQ ID NO:16).

In some embodiments, this invention provides an isolated polypeptide encoding for an edge portion of HSFLT_P6 (SEQ ID NO:16), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPE-PQITWFKNNHKIQQEPGIILGPGSSTLFIERVTEE-DEGVYHCK ATNQKGSVESSAYLTVQGTSDKSNLEL-ITLTCTCVAATLFWLLLTLFIRKMKRSSSEIKT-DYLSIIMDPDEVPLDE QCERLPYDASKWEFAR-ERLKLGKSLGRGAFGKVVQASAFGIKKSPTCRTV-AVKMLKEGATASEYKALMTELK ILTHIGHHLNVVN-LLGACTKQGGPLMVIVEYCKYGNLSNYLKSKRD-LFFLNKDAALHMEPKKEKMEPGLEQG KKPRLDS-VTSSESFASSGFQEDKSLSDVEEEEDSDGFYKEPI-TMEDLISYSFQVARGMEFLSSRKCIHRDLAARNI LLSENNVVKICDFGLARDIYKNPDYVRKGDTR-LPLKWMAPESIFDKIYSTKSDVWSYGVLLWEIF-SLGGSPYPG VQMDEDFCSRLREGMRMRAPEYST-PEIYQIMLDCWHRDPKERPRFAELVEKLGDLLQA-NVQQDGKDYIPINAI LTGNSGFTYSTPAFSEDFFKESI-SAPKFNSGSSDDVRYVNAFKFMSLERIKTFEELLP-NATSMFDDYQGDSSTLL ASPMLKRFTWTDSKP-KASLKIDLRVTSKSKESGLSDVSRPSFCHSSCGH-VSEGKRRFTYDHAELERKIACCSPPP DYNSVVLYST-PPI (SEQ ID NO: 460) of HSFLT_P6 (SEQ ID NO:16).

In some embodiments, such isolated chimeric proteins or polypeptides may comprise an amino acid sequence corresponding to or homologous to that set forth in HSFLT_P7 (SEQ ID NO:17).

In some embodiments, this invention provides an isolated chimeric polypeptide as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), and a second amino acid sequence being at least 90% homologous to amino acids 172-1338 of VGR1_HUMAN_V1 (SEQ ID NO: 575), which also corresponds to amino acids 7-1173 of HSFLT_P7 (SEQ ID NO:17), wherein said first amino acid sequence and second amino acid sequence are contiguous and in a sequential order.

In some embodiments, this invention provides an isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

In some embodiments, the isolated chimeric proteins or polypeptides of the invention may comprise an amino acid sequence corresponding to or homologous to that, as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), and a second amino acid sequence being at least 90% homologous to amino acids 172-1338 of NP_002010_V1 (SEQ ID NO: 574), which also corresponds to amino acids 7-1173 of HSFLT_P7 (SEQ ID NO:17), wherein said first amino acid sequence and second amino acid sequence are contiguous and in a sequential order.

In some embodiments, this invention provides an isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

In some embodiments, the isolated chimeric proteins or polypeptides of the invention may comprise an amino acid sequence corresponding to or homologous to that as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), a second amino acid sequence being at least 90% homologous to amino acids 172-656 of P17948-2 (SEQ ID NO:360), which also corresponds to amino acids 7-491 of HSFLT_P7 (SEQ ID NO:17), and a third amino acid sequence being at least 70%, optionally at least 80%, preferably at least 85%, more preferably at least 90% and most preferably at least 95% homologous to a polypeptide having the sequence DQEAPY-LLRNLSDHTVAISSSTTLDCHANGVPEPQITWFKNN-HKIQQEPGIILGPGSSTLFIERVTEEDEGVYHCK ATNQKGSVESSAYLTVQGTSDKSNLELITLTCTC-VAATLFWLLLTLFIRKMKRSSSEIKTDYLSIIMDP-DEVPLDE QCERLPYDASKWEFARERLKLGKSLGR-GAFGKVVQASAFGIKKSPTCRTVAVKMLKEGATA-SEYKALMTELK ILTHIGHHLNVVNLLGACTKQGG-PLMVIVEYCKYGNLSNYLKSKRDLFFLNKDAA-LHMEPKKEKMEPGLEQG KKPRLDSVTSSESFASSG-FQEDKSLSDVEEEEDSDGFYKEPITMEDLISYSFQVA-RGMEFLSSRKCIHRDLAARNI LLSENNVVKICDF-GLARDIYKNPDYVRKGDTRLPLKWMAPESIFDKIY-STKSDVWSYGVLLWEIFSLGGSPYPG VQMDEDFCS-RLREGMRMRAPEYSTPEIYQIMLDCWHRDPKER-PRFAELVEKLGDLLQANVQQDGKDYIPINAI LTGNS-GFTYSTPAFSEDFFKESISAPKFNSGSSDDVRYVNA-FKFMSLERIKTFEELLPNATSMFDDYQGDSSTLL ASP-MLKRFTWTDSKPKASLKIDLRVTSKSKESGLSDV-SRPSFCHSSCGHVSEGKRRFTYDHAELERKIACC-SPPP DYNSVVLYSTPPI (SEQ ID NO: 460) corresponding to amino acids 492-1173 of HSFLT_P7 (SEQ ID NO:17), wherein said first amino acid sequence, second amino acid sequence and third amino acid sequence are contiguous and in a sequential order.

In some embodiments, this invention provides an isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

In some embodiments, this invention provides an isolated polypeptide encoding for an edge portion of HSFLT_P7 (SEQ ID NO:17), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPGIILGPGSSTLFIERVTEEDEGVYHCK ATNQKGSVESSAYLTVQGTSDKSNLELITLTCTCVAATLFWLLLTLFIRKMKRSSSEIKTDYLSIIMDPDEVPLDE QCERLPYDASKWEFARERLKLGKSLGRGAFGKVVQASAFGIKKSPTCRTVAVKMLKEGATASEYKALMTELK ILTHIGHHLNVVNLLGACTKQGGPLMVIVEYCKYGNLSNYLKSKRDLFFLNKDAALHMEPKKEKMEPGLEQG KKPRLDSVTSSESFASSGFQEDKSLSDVEEEEDSDGFYKEPITMEDLISYSFQVARGMEFLSSRKCIHRDLAARNI LLSENNVVKICDFGLARDIYKNPDYVRKGDTRLPLKWMAPESIFDKIYSTKSDVWSYGVLLWEIFSLGGSPYPG VQMDEDFCSRLREGMRMRAPEYSTPEIYQIMLDCWHRDPKERPRFAELVEKLGDLLQANVQQDGKDYIPINAI LTGNSGFTYSTPAFSEDFFKESISAPKFNSGSSDDVRYVNAFKFMSLERIKTFEELLPNATSMFDDYQGDSSTLL ASPMLKRFTWTDSKPKASLKIDLRVTSKSKESGLSDVSRPSFCHSSCGHVSEGKRRFTYDHAELERKIACCSPPP DYNSVVLYSTPPI (SEQ ID NO: 460) of HSFLT_P7 (SEQ ID NO:17).

In some embodiments, such isolated chimeric proteins or polypeptides may comprise an amino acid sequence corresponding to or homologous to that set forth in HSFLT_P10 (SEQ ID NO:18).

In some embodiments, the isolated chimeric proteins or polypeptides of the invention may comprise an amino acid sequence corresponding to or homologous to that as set forth in HSFLT_P10 (SEQ ID NO:18), comprising a first amino acid sequence being at least 90% homologous to amino acids 1-705 of VGR1_HUMAN (SEQ ID NO: 359), which also corresponds to amino acids 1-705 of HSFLT_P10 (SEQ ID NO:18), and a second amino acid sequence being at least 70%, optionally at least 80%, preferably at least 85%, more preferably at least 90% and most preferably at least 95% homologous to a polypeptide having the sequence ELYTSTSPSSSSSSPLSSSSSSSSSSSS (SEQ ID NO: 462) corresponding to amino acids 706-733 of HSFLT_P10 (SEQ ID NO:18), wherein said first amino acid sequence and second amino acid sequence are contiguous and in a sequential order.

In some embodiments, this invention provides an isolated polypeptide encoding for an edge portion of HSFLT_P10 (SEQ ID NO:18), comprising an amino acid sequence being at least 70%, optionally at least about 80%, preferably at least about 85%, more preferably at least about 90% and most preferably at least about 95% homologous to the sequence ELYTSTSPSSSSSSPLSSSSSSSSSSSS (SEQ ID NO: 462) of HSFLT_P10 (SEQ ID NO:18).

In some embodiments, the isolated chimeric proteins or polypeptides of the invention may comprise an amino acid sequence corresponding to or homologous to that as set forth in HSFLT_P10 (SEQ ID NO:18), comprising a first amino acid sequence being at least 90% homologous to amino acids 1-656 of P17948-2 (SEQ ID NO:360), which also corresponds to amino acids 1-656 of HSFLT_P10 (SEQ ID NO:18), and a second amino acid sequence being at least 70%, optionally at least 80%, preferably at least 85%, more preferably at least 90% and most preferably at least 95% homologous to a polypeptide having the sequence DQEAPYLLRNLSDHTVAISSSTTLDCHANGVPEPQITWFKNNHKIQQEPELYTSTSPSSSSSSPLSSSSSSSSSSSS (SEQ ID NO: 463) corresponding to amino acids 657-733 of HSFLT_P10 (SEQ ID NO:18), wherein said first amino acid sequence and second amino acid sequence are contiguous and in a sequential order.

In some embodiments, this invention provides an isolated polypeptide encoding for an edge portion of HSFLT_P10 (SEQ ID NO:18), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPELYTSTSPSSSSSSPLSSSSSSSSSSSS (SEQ ID NO: 463) of HSFLT_P10 (SEQ ID NO:18).

In some embodiments, the isolated chimeric proteins or polypeptides of the invention may comprise an amino acid sequence corresponding to or homologous to that as set forth in HSFLT_P10 (SEQ ID NO:18), comprising a first amino acid sequence being at least 90% homologous to amino acids 1-705 of NP_002010 (SEQ ID NO: 531), which also corresponds to amino acids 1-705 of HSFLT_P10 (SEQ ID NO:18), and a second amino acid sequence being at least 70%, optionally at least 80%, preferably at least 85%, more preferably at least 90% and most preferably at least 95% homologous to a polypeptide having the sequence ELYTSTSPSSSSSSPLSSSSSSSSSSSS (SEQ ID NO: 462) corresponding to amino acids 706-733 of HSFLT_P10 (SEQ ID NO:18), wherein said first amino acid sequence and second amino acid sequence are contiguous and in a sequential order.

In some embodiments, such isolated chimeric proteins or polypeptides may comprise an amino acid sequence corresponding to or homologous to that set forth in HSFLT_P11 (SEQ ID NO:19).

In some embodiments, the isolated chimeric proteins or polypeptides of the invention may comprise an amino acid sequence corresponding to or homologous to that as set forth in HSFLT_P11 (SEQ ID NO:19), comprising a first amino acid sequence being at least 90% homologous to amino acids 1-706 of VGR1_HUMAN (SEQ ID NO: 359), which also corresponds to amino acids 1-706 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence SANTAVNKKTEI (SEQ ID NO: 464) corresponding to amino acids 707-718 of HSFLT_P11 (SEQ ID NO:19), wherein said first amino acid sequence and second amino acid sequence are contiguous and in a sequential order.

In some embodiments, this invention provides an isolated polypeptide encoding for an edge portion of HSFLT_P11 (SEQ ID NO:19), comprising an amino acid sequence being at least 70%, optionally at least about 80%, preferably at least about 85%, more preferably at least about 90% and most preferably at least about 95% homologous to the sequence SANTAVNKKTEI (SEQ ID NO: 464) of HSFLT_P11 (SEQ ID NO:19).

In some embodiments, the isolated chimeric proteins or polypeptides of the invention may comprise an amino acid sequence corresponding to or homologous to that as set forth in HSFLT_P11 (SEQ ID NO:19), comprising a first amino acid sequence being at least 90% homologous to amino acids 1-656 of P17948-2 (SEQ ID NO:360), which also corresponds to amino acids 1-656 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence DQEAPYLLRNLSDHTVAISSSTTLDCHANGVPEPQITWFKNNHKIQQEPGSANTAVNKKTEI (SEQ ID NO: 465) corresponding to amino acids 657-718 of HSFLT_P11 (SEQ ID NO:19), wherein said first amino acid sequence and second amino acid sequence are contiguous and in a sequential order.

In some embodiments, this invention provides an isolated polypeptide encoding for an edge portion of HSFLT_P11 (SEQ ID NO:19), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPGSANTAVNKKTEI (SEQ ID NO: 465) of HSFLT_P11 (SEQ ID NO:19).

In some embodiments, the isolated chimeric proteins or polypeptides of the invention may comprise an amino acid sequence corresponding to or homologous to that as set forth in HSFLT_P11 (SEQ ID NO:19), comprising a first amino acid sequence being at least 90% homologous to amino acids 1-706 of NP_002010 (SEQ ID NO: 531), which also corresponds to amino acids 1-706 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence SANTAVNKKTEI (SEQ ID NO: 464) corresponding to amino acids 707-718 of HSFLT_P11 (SEQ ID NO:19), wherein said first amino acid sequence and second amino acid sequence are contiguous and in a sequential order.

In some embodiments, such isolated chimeric proteins or polypeptides may comprise an amino acid sequence corresponding to or homologous to that set forth in HSFLT_P13 (SEQ ID NO:20).

In some embodiments, the isolated chimeric proteins or polypeptides of the invention may comprise an amino acid sequence corresponding to or homologous to that as set forth in HSFLT_P13 (SEQ ID NO:20), comprising a first amino acid sequence being at least 90% homologous to amino acids 1-706 of VGR1_HUMAN (SEQ ID NO: 359), which also corresponds to amino acids 1-706 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence KRLFFLPFIISHLSSAPLSLNSPVTCFQYV (SEQ ID NO: 466) corresponding to amino acids 707-736 of HSFLT_P13 (SEQ ID NO:20), wherein said first amino acid sequence and second amino acid sequence are contiguous and in a sequential order.

In some embodiments, this invention provides an isolated polypeptide encoding for an edge portion of HSFLT_P13 (SEQ ID NO:20), comprising an amino acid sequence being at least 70%, optionally at least about 80%, preferably at least about 85%, more preferably at least about 90% and most preferably at least about 95% homologous to the sequence KRLFFLPFIISHLSSAPLSLNSPVTCFQYV (SEQ ID NO: 466) of HSFLT_P13 (SEQ ID NO:20).

In some embodiments, the isolated chimeric proteins or polypeptides of the invention may comprise an amino acid sequence corresponding to or homologous to that as set forth in HSFLT_P13 (SEQ ID NO:20), comprising a first amino acid sequence being at least 90% homologous to amino acids 1-656 of P17948-2 (SEQ ID NO:360), which also corresponds to amino acids 1-656 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence DQEAPYLLRNLSDHTVAISSSTTLDCHANGVPEPQITWFKNNHKIQQEPGKRLFFLPFIISHLSSAPLSLNSPVTCFQYV (SEQ ID NO: 467) corresponding to amino acids 657-736 of HSFLT_P13 (SEQ ID NO:20), wherein said first amino acid sequence and second amino acid sequence are contiguous and in a sequential order.

In some embodiments, this invention provides an isolated polypeptide encoding for an edge portion of HSFLT_P13 (SEQ ID NO:20), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPGKRLFFLPFIISHLSSAPLSLNSPVTCFQYV (SEQ ID NO: 467) of HSFLT_P13 (SEQ ID NO:20).

In some embodiments, the isolated chimeric proteins or polypeptides of the invention may comprise an amino acid sequence corresponding to or homologous to that as set forth in HSFLT_P13 (SEQ ID NO:20), comprising a first amino acid sequence being at least 90% homologous to amino acids 1-706 of NP_002010 (SEQ ID NO: 531), which also corresponds to amino acids 1-706 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence KRLFFLPFIISHLSSAPLSLNSPVTCFQYV (SEQ ID NO: 466) corresponding to amino acids 707-736 of HSFLT_P13 (SEQ ID NO:20), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSFLT_P14 (SEQ ID NO:21), comprising a first amino acid sequence being at least 90% homologous to amino acids 1-517 of VGR1_HUMAN (SEQ ID NO: 359), which also corresponds to amino acids 1-517 of HSFLT_P14 (SEQ ID NO:21), and a second amino acid sequence being at least 70%, optionally at least 80%, preferably at least 85%, more preferably at least 90% and most preferably at least 95% homologous to a polypeptide having the sequence YLDIRTEEQIFSFIQKTQTLKLTVSCKAAF (SEQ ID NO: 468) corresponding to amino acids 518-547 of HSFLT_P14 (SEQ ID NO:21), wherein said first amino acid sequence and second amino acid sequence are contiguous and in a sequential order.

In some embodiments, this invention provides an isolated polypeptide encoding for an edge portion of HSFLT_P14 (SEQ ID NO:21), comprising an amino acid sequence being at least 70%, optionally at least about 80%, preferably at least about 85%, more preferably at least about 90% and most preferably at least about 95% homologous to the sequence YLDIRTEEQIFSFIQKTQTLKLTVSCKAAF (SEQ ID NO: 468) of HSFLT_P14 (SEQ ID NO:21).

In some embodiments, the isolated chimeric proteins or polypeptides of the invention may comprise an amino acid sequence corresponding to or homologous to that as set forth in HSFLT_P15 (SEQ ID NO:22), comprising a first amino acid sequence being at least 90% homologous to amino acids 1-329 of VGR1_HUMAN (SEQ ID NO: 359), which also corresponds to amino acids 1-329 of HSFLT_P15 (SEQ ID NO:22), and a second amino acid sequence being at least 70%, optionally at least 80%, preferably at least 85%, more preferably at least 90% and most preferably at least 95% homologous to a polypeptide having the sequence GKHSSALPTHAMLSNHCRCLCSLNKSVFCWPRVTLS (SEQ ID NO: 469) corresponding to amino acids 330-365 of HSFLT_P15 (SEQ ID NO:22), wherein said first amino acid sequence and second amino acid sequence are contiguous and in a sequential order.

In some embodiments, this invention provides an isolated polypeptide encoding for an edge portion of HSFLT_P15 (SEQ ID NO:22), comprising an amino acid sequence being at least 70%, optionally at least about 80%, preferably at least about 85%, more preferably at least about 90% and most preferably at least about 95% homologous to the sequence GKHSSALPTHAMLSNHCRCLCSLNKSVFCWPRVTLS (SEQ ID NO: 469) of HSFLT_P15 (SEQ ID NO:22).

In some embodiments, the isolated chimeric proteins or polypeptides of the invention may comprise an amino acid sequence corresponding to or homologous to that as set forth in HSFLT_P16 (SEQ ID NO:23), comprising an amino acid sequence being at least 90% homologous to amino acids 906-1338 of VGR1_HUMAN (SEQ ID NO: 359), which also corresponds to amino acids 1-433 of HSFLT_P16 (SEQ ID NO:23).

In some embodiments, the isolated chimeric proteins or polypeptides of the invention may comprise an amino acid sequence corresponding to or homologous to that as set forth in HSFLT_P16 (SEQ ID NO:23), comprising an amino acid sequence being at least 90% homologous to amino acids 906-1338 of NP_002010 (SEQ ID NO: 531), which also corresponds to amino acids 1-433 of HSFLT_P16 (SEQ ID NO:23).

In some embodiments, the isolated chimeric proteins or polypeptides of the invention may comprise an amino acid sequence corresponding to or homologous to that as set forth in HSFLT_P17 (SEQ ID NO:24), comprising a first amino acid sequence being at least 90% homologous to amino acids 1-171 of VGR1_HUMAN (SEQ ID NO: 359), which also corresponds to amino acids 1-171 of HSFLT_P17 (SEQ ID NO:24), and a second amino acid sequence being at least 70%, optionally at least 80%, preferably at least 85%, more preferably at least 90% and most preferably at least 95% homologous to a polypeptide having the sequence VNLNTAILSILSLQISIMKFYSFYLSGIISLQTPGLLSGLSCN (SEQ ID NO: 470) corresponding to amino acids 172-214 of HSFLT_P17 (SEQ ID NO:24), wherein said first amino acid sequence and second amino acid sequence are contiguous and in a sequential order.

In some embodiments, this invention provides an isolated polypeptide encoding for an edge portion of HSFLT_P17 (SEQ ID NO:24), comprising an amino acid sequence being at least 70%, optionally at least about 80%, preferably at least about 85%, more preferably at least about 90% and most preferably at least about 95% homologous to the sequence VNLNTAILSILSLQISIMKFYSFYLSGIISLQTPGLLSGLSCN (SEQ ID NO: 470) of HSFLT_P17 (SEQ ID NO:24).

In some embodiments, the isolated chimeric proteins or polypeptides of the invention may comprise an amino acid sequence corresponding to or homologous to that as set forth in HSFLT_P18 (SEQ ID NO:25), comprising an amino acid sequence being at least 90% homologous to amino acids 996-1338 of VGR1_HUMAN (SEQ ID NO: 359), which also corresponds to amino acids 1-343 of HSFLT_P18 (SEQ ID NO:25).

In some embodiments, the isolated chimeric proteins or polypeptides of the invention may comprise an amino acid sequence corresponding to or homologous to that as set forth in HSFLT_P18 (SEQ ID NO:25), comprising an amino acid sequence being at least 90% homologous to amino acids 996-1338 of NP_002010 (SEQ ID NO: 531), which also corresponds to amino acids 1-343 of HSFLT_P18 (SEQ ID NO:25).

In some embodiments, the isolated chimeric proteins or polypeptides of the invention may comprise an amino acid sequence corresponding to or homologous to that as set forth in HSFLT_P19 (SEQ ID NO:26), comprising a first amino acid sequence being at least 90% homologous to amino acids 1-129 of VGR1_HUMAN (SEQ ID NO: 359), which also corresponds to amino acids 1-129 of HSFLT_P19 (SEQ ID NO:26), and a second amino acid sequence being at least 70%, optionally at least 80%, preferably at least 85%, more preferably at least 90% and most preferably at least 95% homologous to a polypeptide having the sequence GKTSIFYILFAFALQMSHKSTLIHWKGCFPSEYERNGLGKRFHPSCRHFRGCQF (SEQ ID NO: 471) corresponding to amino acids 130-183 of HSFLT_P19 (SEQ ID NO:26), wherein said first amino acid sequence and second amino acid sequence are contiguous and in a sequential order.

In some embodiments, this invention provides isolated polypeptide encoding for an edge portion of HSFLT_P19 (SEQ ID NO:26), comprising an amino acid sequence being at least 70%, optionally at least about 80%, preferably at least about 85%, more preferably at least about 90% and most preferably at least about 95% homologous to the sequence GKTSIFYILFAFALQMSHKSTLIHWKGCFPSEYERNGLGKRFHPSCRHFRGCQF (SEQ ID NO: 471) of HSFLT_P19 (SEQ ID NO:26).

In some embodiments, the isolated chimeric proteins or polypeptides of the invention may comprise an amino acid sequence corresponding to or homologous to that as set forth in HSFLT_P20 (SEQ ID NO:27), comprising an amino acid sequence being at least 90% homologous to amino acids 1133-1338 of VGR1_HUMAN (SEQ ID NO: 359), which also corresponds to amino acids 1-206 of HSFLT_P20 (SEQ ID NO:27).

In some embodiments, the isolated chimeric proteins or polypeptides of the invention may comprise an amino acid sequence corresponding to or homologous to that as set forth in HSFLT_P21 (SEQ ID NO:28), comprising an amino acid sequence being at least 90% homologous to amino acids 1220-1338 of VGR1_HUMAN (SEQ ID NO: 359), which also corresponds to amino acids 1-119 of HSFLT_P21 (SEQ ID NO:28).

In some embodiments, the isolated chimeric proteins or polypeptides of the invention may comprise an amino acid sequence corresponding to or homologous to that as set forth in HSFLT_P41 (SEQ ID NO:29), comprising a first amino acid sequence being at least 70%, optionally at least 80%, preferably at least 85%, more preferably at least 90% and most preferably at least 95%, homologous to a polypeptide having the sequence LWAACPAQACSGNAGQERGGLQSAAGLPSQPSCFLQTGVGLANQ (SEQ ID NO: 577) corresponding to amino acids 1-44 of HSFLT_P41 (SEQ ID NO:29), and a second amino acid sequence being at least 90% homologous to amino acids 903-1338 of VGR1_HUMAN (SEQ ID NO: 359), which also corresponds to amino acids 45-480 of HSFLT_P41 (SEQ ID NO:29), wherein said first amino acid sequence and second amino acid sequence are contiguous and in a sequential order.

In some embodiments, this invention provides isolated polypeptide encoding for a head of HSFLT_P41 (SEQ ID NO:29), comprising a polypeptide being at least 70%, optionally at least about 80%, preferably at least about 85%, more preferably at least about 90% and most preferably at least about 95% homologous to the sequence LWAACPAQACSGNAGQERGGLQSAAGLPSQPSCFLQTGVGLANQ (SEQ ID NO: 577) of HSFLT_P41 (SEQ ID NO:29).

In some embodiments, the isolated chimeric proteins or polypeptides of the invention may comprise an amino acid sequence corresponding to or homologous to that as set forth in HSFLT_P48 (SEQ ID NO:30), comprising a first amino acid sequence being at least 90% homologous to amino acids 1-517 of VGR1_HUMAN (SEQ ID NO: 359), which also corresponds to amino acids 1-517 of HSFLT_P48 (SEQ ID NO:30), and a second amino acid sequence being at least 70%, optionally at least 80%, preferably at least 85%, more preferably at least 90% and most preferably at least 95% homologous to a polypeptide having the sequence LPPANSSFMLPPTSFSSNYFHFLP (SEQ ID NO: 472) corresponding to amino acids 518-541 of HSFLT_P48 (SEQ ID NO:30), wherein said first amino acid sequence and second amino acid sequence are contiguous and in a sequential order.

In some embodiments, this invention provides isolated polypeptide encoding for an edge portion of HSFLT_P48 (SEQ ID NO:30), comprising an amino acid sequence being at least 70%, optionally at least about 80%, preferably at least about 85%, more preferably at least about 90% and most preferably at least about 95% homologous to the sequence LPPANSSFMLPPTSFSSNYFHFLP (SEQ ID NO: 472) of HSFLT_P48 (SEQ ID NO:30).

In some embodiments, the isolated chimeric proteins or polypeptides of the invention may comprise an amino acid sequence corresponding to or homologous to that as set forth in HSFLT_P49 (SEQ ID NO:31), comprising a first amino acid sequence being at least 90% homologous to amino acids 1-553 of VGR1_HUMAN (SEQ ID NO: 359), which also corresponds to amino acids 1-553 of HSFLT_P49 (SEQ ID NO:31), and a second amino acid sequence being at least 70%, optionally at least 80%, preferably at least 85%, more preferably at least 90% and most preferably at least 95% homologous to a polypeptide having the sequence ELSNFECLHPCSQE (SEQ ID NO: 473) corresponding to amino acids 554-567 of HSFLT_P49 (SEQ ID NO:31), wherein said first amino acid sequence and second amino acid sequence are contiguous and in a sequential order.

In some embodiments, this invention provides an isolated polypeptide encoding for an edge portion of HSFLT_P49 (SEQ ID NO:31), comprising an amino acid sequence being at least 70%, optionally at least about 80%, preferably at least about 85%, more preferably at least about 90% and most preferably at least about 95% homologous to the sequence ELSNFECLHPCSQE (SEQ ID NO: 473) of HSFLT_P49 (SEQ ID NO:31).

In some embodiments, the isolated chimeric proteins or polypeptides of the invention may comprise an amino acid sequence corresponding to or homologous to that as set forth in HSI1RA_P5 (SEQ ID NO:65), comprising a first amino acid sequence being at least 90% homologous to amino acids 35-68 of IL1X_HUMAN (SEQ ID NO: 372), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

In some embodiments, this invention provides an isolated polypeptide encoding for an edge portion of HSI1RA_P5 (SEQ ID NO:65), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P5 (SEQ ID NO:65).

In some embodiments, the isolated chimeric proteins or polypeptides of the invention may comprise an amino acid sequence corresponding to or homologous to that as set forth in HSI1RA_P5 (SEQ ID NO:65), comprising a first amino acid sequence being at least 90% homologous to amino acids 17-50 of NP_000568 (SEQ ID NO: 532), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P5 (SEQ ID NO:65), comprising a first amino acid sequence being at least 90% homologous to amino acids 35-68 of NP_776214 (SEQ ID NO: 534), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P5 (SEQ ID NO:65), comprising a first amino acid sequence being at least 90% homologous to amino acids 38-71 of NP_776213 (SEQ ID NO: 533), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P6 (SEQ ID NO:66), comprising a first amino acid sequence being at least 90% homologous to amino acids 1-68 of IL1X_HUMAN (SEQ ID NO: 372), which also corresponds to amino acids 1-68 of HSI1RA_P6 (SEQ ID NO:66), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P6 (SEQ ID NO:66), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P6 (SEQ ID NO:66), a second amino acid sequence being at least 90% homologous to amino acids 4-50 of P18510-2 (SEQ ID NO:373), which also corresponds to amino acids 22-68 of HSI1RA_P6 (SEQ ID NO:66), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence, second amino acid sequence and third amino acid sequence are contiguous and in a sequential order.

An isolated polypeptide encoding for a head of HSI1RA_P6 (SEQ ID NO:66), comprising a polypeptide being at least 70%, optionally at least about 80%, preferably at least about 85%, more preferably at least about 90% and most preferably at least about 95% homologous to the sequence MEICRGLRSHLITLLLFLFHS (SEQ ID NO: 578) of HSI1RA_P6 (SEQ ID NO:66).

In some embodiments, the isolated chimeric proteins or polypeptides of the invention may comprise an amino acid sequence corresponding to or homologous to that as set forth in HSI1RA_P6 (SEQ ID NO:66), comprising a first amino acid sequence being at least 70%, optionally at least 80%, preferably at least 85%, more preferably at least 90% and most preferably at least 95% homologous to a polypeptide having the sequence MEICRGLRSHLITLLLFLFHSETICRPSGRKSSK (SEQ ID NO: 579) corresponding to amino acids 1-34 of HSI1RA_P6 (SEQ ID NO:66), a second amino acid sequence being at least 90% homologous to amino acids 1-34 of P18510-4 (SEQ ID NO:375), which also corresponds to amino acids 35-68 of HSI1RA_P6 (SEQ ID NO:66), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence, second amino acid sequence and third amino acid sequence are contiguous and in a sequential order.

An isolated polypeptide encoding for a head of HSI1RA_P6 (SEQ ID NO:66), comprising a polypeptide being at least 70%, optionally at least about 80%, preferably at least about 85%, more preferably at least about 90% and most preferably at least about 95% homologous to the sequence MEICRGLRSHLITLLLFLFHSETICRPSGRKSSK (SEQ ID NO: 579) of HSI1RA_P6 (SEQ ID NO:66).

In some embodiments, the isolated chimeric proteins or polypeptides of the invention may comprise an amino acid sequence corresponding to or homologous to that as set forth in HSI1RA_P13 (SEQ ID NO:67), comprising a first amino acid sequence being at least 70%, optionally at least 80%, preferably at least 85%, more preferably at least 90% and most preferably at least 95% homologous to a polypeptide having the sequence MAL (SEQ ID NO: 580) corresponding to amino acids 1-3 of HSI1RA_P13 (SEQ ID NO:67), a second amino acid sequence being at least 90% homologous to amino acids 22-68 of IL1X_HUMAN (SEQ ID NO: 372), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P13 (SEQ ID NO:67), comprising a first amino acid sequence being at least 90% homologous to amino acids 1-50 of NP_000568 (SEQ ID NO: 532), which also corresponds to amino acids 1-50 of HSI1RA_P13 (SEQ ID NO:67), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P13 (SEQ ID NO:67), comprising a first amino acid sequence being at least 90% homologous to amino acids 1-3 of P18510-3 (SEQ ID NO:374), which also corresponds to amino acids 1-3 of HSI1RA_P13 (SEQ ID NO:67), a second amino acid sequence being at least 90% homologous to amino acids 25-71 of P18510-3 (SEQ ID NO:374), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

In some embodiments, this invention provides an isolated chimeric polypeptide encoding for an edge portion of HSI1RA_P13 (SEQ ID NO:67), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LE, having a structure as follows: a sequence starting from any of amino acid numbers 3−x to 3; and ending at any of amino acid numbers 4+((n−2)−x), in which x varies from 0 to n−2.

In some embodiments, the isolated chimeric proteins or polypeptides of the invention may comprise an amino acid sequence corresponding to or homologous to that as set forth in HSI1RA_P13 (SEQ ID NO:67), comprising a first amino acid sequence being at least 70%, optionally at least 80%, preferably at least 85%, more preferably at least 90% and most preferably at least 95% homologous to a polypeptide having the sequence MAL (SEQ ID NO: 580) corresponding to amino acids 1-3 of HSI1RA_P13 (SEQ ID NO:67), a second amino acid sequence being at least 90% homologous to ETICRPSGRKSSKMQAFRIWDVNQKT-FYLRNNQLVAGYLQGPNVNLE corresponding to amino acids 22-68 of NP_776214 (SEQ ID NO: 534), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKP-MYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P13 (SEQ ID NO:67), comprising a first amino acid sequence being at least 70%, optionally at least 80%, preferably at least 85%, more preferably at least 90% and most preferably at least 95%, homologous to a polypeptide having the sequence MALETICRPSGRKSSK (SEQ ID NO: 581) corresponding to amino acids 1-16 of HSI1RA_P13 (SEQ ID NO:67), a second amino acid sequence being at least 90% homologous to amino acids 1-34 of P18510-4 (SEQ ID NO:375), which also corresponds to amino acids 17-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMA-CLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

An isolated polypeptide encoding for a head of HSI1RA_P13 (SEQ ID NO:67), comprising a polypeptide being at least 70%, optionally at least about 80%, preferably at least about 85%, more preferably at least about 90% and most preferably at least about 95% homologous to the sequence MALETICRPSGRKSSK (SEQ ID NO: 581) of HSI1RA_P13 (SEQ ID NO:67).

In some embodiments, the isolated chimeric proteins or polypeptides of the invention may comprise an amino acid sequence corresponding to or homologous to that as set forth in HSI1RA_P14 (SEQ ID NO:68), comprising a first amino acid sequence being at least 90% homologous to amino acids 1-24 of NP_776213 (SEQ ID NO: 533), which also corresponds to amino acids 1-24 of HSI1RA_P14 (SEQ ID NO:68), and a second amino acid sequence being at least 70%, optionally at least 80%, preferably at least 85%, more preferably at least 90% and most preferably at least 95% homologous to a polypeptide having the sequence GGL (SEQ ID NO: 477) corresponding to amino acids 25-27 of HSI1RA_P14 (SEQ ID NO:68), wherein said first amino acid sequence and second amino acid sequence are contiguous and in a sequential order.

In some embodiments, this invention provides an isolated polypeptide encoding for an edge portion of HSI1RA_P14 (SEQ ID NO:68), comprising an amino acid sequence being at least 70%, optionally at least about 80%, preferably at least about 85%, more preferably at least about 90% and most preferably at least about 95% homologous to the sequence GGL (SEQ ID NO: 477) of HSI1RA_P14 (SEQ ID NO:68).

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 90% homologous to amino acids 1-68 of IL1X_HUMAN (SEQ ID NO: 372), which also corresponds to amino acids 1-68 of HSI1RA_P16 (SEQ ID NO:69), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence and second amino acid sequence are contiguous and in a sequential order.

In some embodiments, this invention provides an isolated polypeptide encoding for an edge portion of HSI1RA_P16 (SEQ ID NO:69), comprising an amino acid sequence being at least 70%, optionally at least about 80%, preferably at least about 85%, more preferably at least about 90% and most preferably at least about 95% homologous to the sequence DRCGTH (SEQ ID NO: 478) of HSI1RA_P16 (SEQ ID NO:69).

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P16 (SEQ ID NO:69), a second amino acid sequence being at least 90% homologous to amino acids 4-50 of P18510-2 (SEQ ID NO:373), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

An isolated polypeptide encoding for a head of HSI1RA_P16 (SEQ ID NO:69), comprising a polypeptide being at least 70%, optionally at least about 80%, preferably at least about 85%, more preferably at least about 90% and most preferably at least about 95% homologous to the sequence MEICRGLRSHLITLLLFLFHS (SEQ ID NO: 578) of HSI1RA_P16 (SEQ ID NO:69).

An isolated chimeric polypeptide as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO:

578) corresponding to amino acids 1-21 of HSI1RA_P16 (SEQ ID NO:69), a second amino acid sequence being at least 90% homologous to amino acids 25-71 of NP_776213 (SEQ ID NO: 533), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHSETICRPSGRKSSK (SEQ ID NO: 579) corresponding to amino acids 1-34 of HSI1RA_P16 (SEQ ID NO:69), a second amino acid sequence being at least 90% homologous to amino acids 1-34 of P18510-4 (SEQ ID NO:375), which also corresponds to amino acids 35-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

In some embodiments, this invention provides an isolated polypeptide encoding for a head of HSI1RA_P16 (SEQ ID NO:69), comprising a polypeptide being at least 70%, optionally at least about 80%, preferably at least about 85%, more preferably at least about 90% and most preferably at least about 95% homologous to the sequence MEICRGLRSHLITLLLFLFHSETICRPSGRKSSK (SEQ ID NO: 579) of HSI1RA_P16 (SEQ ID NO:69).

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 90% homologous to amino acids 1-68 of IL1X_HUMAN (SEQ ID NO: 372), which also corresponds to amino acids 1-68 of HSI1RA_P16 (SEQ ID NO:69), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P16 (SEQ ID NO:69), a second amino acid sequence being at least 90% homologous to amino acids 4-50 of P18510-2 (SEQ ID NO:373), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P16 (SEQ ID NO:69), a second amino acid sequence being at least 90% homologous amino acids 25-71 of NP_776213 (SEQ ID NO: 533), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHSETICRPSGRKSSK (SEQ ID NO: 579) corresponding to amino acids 1-34 of HSI1RA_P16 (SEQ ID NO:69), a second amino acid sequence being at least 90% homologous to amino acids 1-34 of P18510-4 (SEQ ID NO:375), which also corresponds to amino acids 35-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

In some embodiments, the isolated chimeric proteins or polypeptides of the invention may comprise an amino acid sequence corresponding to or homologous to that as set forth in HSI1RA_P17 (SEQ ID NO:70), comprising a first amino acid sequence being at least 90% homologous to amino acids 35-68 of IL1X_HUMAN (SEQ ID NO: 372), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said, first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P17 (SEQ ID NO:70), comprising a first amino acid sequence being at least 90% homologous to amino acids 1-34 of P18510-4 (SEQ ID NO:375), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P17 (SEQ ID NO:70), comprising a first amino acid sequence being at least 90% homologous to amino acids 17-50 of NP_000568 (SEQ ID NO: 532), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P17 (SEQ ID NO:70), comprising a first amino acid sequence being at least 90% homologous to amino acids 35-68 of NP_776214 (SEQ ID NO: 534), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSI1RA_P17 (SEQ ID NO:70), comprising a first amino acid sequence being at least 90% homologous to amino acids 38-71 of NP_776213 (SEQ ID NO: 533), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HSPLGF_1_P4 (SEQ ID NO:99), comprising a first amino acid sequence being at least 90% homologous to amino acids 1-140 of P49763-2 (SEQ ID NO: 536), which also corresponds to amino acids 1-140 of HSPLGF_1_P4 (SEQ ID NO:99), and a second amino acid sequence being at least 70%, optionally at least 80%, preferably at least 85%, more preferably at least 90% and most preferably at least 95% homologous to a polypeptide having the sequence SHLVLTLGLLQEETQGQGEEEEREAETHRLP-PVRRCCSPEVTHPLEERDPAPGSCIYYRHTLQ (SEQ ID NO: 480) corresponding to amino acids 141-203 of HSPLGF_1_P4 (SEQ ID NO:99), wherein said first amino acid sequence and second amino acid sequence are contiguous and in a sequential order.

In some embodiments, this invention provides an isolated polypeptide encoding for an edge portion of HSPLGF_1_P4 (SEQ ID NO:99), comprising an amino acid sequence being at least 70%, optionally at least about 80%, preferably at least about 85%, more preferably at least about 90% and most preferably at least about 95% homologous to the sequence SHLVLTLGLLQEETQGQGEEEEREA-ETHRLPPVRRCCSPEVTHPLEERDPAPG-SCIYYRHTLQ (SEQ ID NO: 480) of HSPLGF_1_P4 (SEQ ID NO:99).

In some embodiments, the isolated chimeric proteins or polypeptides of the invention may comprise an amino acid sequence corresponding to or homologous to that as set forth in HSPLGF_1_P13 (SEQ ID NO:101), comprising a amino acid sequence being at least 90% homologous to amino acids 1-141 of P49763-2 (SEQ ID NO: 536), which also corresponds to amino acids 1-141 of HSPLGF_1_P13 (SEQ ID NO:101).

In some embodiments, the isolated chimeric proteins or polypeptides of the invention may comprise an amino acid sequence corresponding to or homologous to that as set forth in HUMSP18A_P3 (SEQ ID NO:127), comprising a first amino acid sequence being at least 70%, optionally at least 80%, preferably at least 85%, more preferably at least 90% and most preferably at least 95%, homologous to a polypeptide having the sequence MHQAGYPGCRGA (SEQ ID NO: 582) corresponding to amino acids 1-12 of HUMSP18A_P3 (SEQ ID NO:127), a second amino acid sequence being at least 90% homologous to amino acids 1-285 of PSPB_HUMAN (SEQ ID NO:406), which also corresponds to amino acids 13-297 of HUMSP18A_P3 (SEQ ID NO:127), and a third amino acid sequence being at least 70%, optionally at least 80%, preferably at least 85%, more preferably at least 90% and most preferably at least 95% homologous to a polypeptide having the sequence SEPTAPSLAQ-CLLSSSPYPATA (SEQ ID NO: 481) corresponding to amino acids 298-319 of HUMSP18A_P3 (SEQ ID NO:127), wherein said first amino acid sequence, second amino acid sequence and third amino acid sequence are contiguous and in a sequential order.

In some embodiments, this invention provides an isolated polypeptide encoding for a head of HUMSP18A_P3 (SEQ ID NO:127), comprising a polypeptide being at least 70%, optionally at least about 80%, preferably at least about 85%, more preferably at least about 90% and most preferably at least about 95% homologous to the sequence MHQAGYPGCRGA (SEQ ID NO: 582) of HUMSP18A_P3 (SEQ ID NO:127).

In some embodiments, this invention provides an isolated polypeptide encoding for an edge portion of HUMSP18A_P3 (SEQ ID NO:127), comprising an amino acid sequence being at least 70%, optionally at least about 80%, preferably at least about 85%, more preferably at least about 90% and most preferably at least about 95% homologous to the sequence SEPTAPSLAQCLLSSSPYPATA (SEQ ID NO: 481) of HUMSP18A_P3 (SEQ ID NO:127).

In some embodiments, the isolated chimeric proteins or polypeptides of the invention may comprise an amino acid sequence corresponding to or homologous to that as set forth in HUMSP18A_P20 (SEQ ID NO:128), comprising a first amino acid sequence being at least 70%, optionally at least 80%, preferably at least 85%, more preferably at least 90% and most preferably at least 95%, homologous to a polypeptide having the sequence MDEMGQVGLVGSCMCLGVL-CWPLPKRTSPLELGASPTHVSSTLGPLPPQ (SEQ ID NO: 583) corresponding to amino acids 1-49 of HUMSP18A_P20 (SEQ ID NO:128), and a second amino acid sequence being at least 90% homologous to amino acids 66-381 of PSPB_HUMAN (SEQ ID NO:406), which also corresponds to amino acids 50-365 of HUMSP18A_P20 (SEQ ID NO:128), wherein said first amino acid sequence and second amino acid sequence are contiguous and in a sequential order.

In some embodiments, this invention provides an isolated polypeptide encoding for a head of HUMSP18A_P20 (SEQ ID NO:128), comprising a polypeptide being at least 70%, optionally at least about 80%, preferably at least about 85%, more preferably at least about 90% and most preferably at least about 95% homologous to the sequence MDEMGQVGLVGSCMCLGVLCWPLP-KRTSPLELGASPTHVSSTLGPLPPQ (SEQ ID NO: 583) of HUMSP18A_P20 (SEQ ID NO:128).

In some embodiments, the isolated chimeric proteins or polypeptides of the invention may comprise an amino acid sequence corresponding to or homologous to that as set forth in HUMSP18A_P22 (SEQ ID NO:129), comprising a first amino acid sequence being at least 70%, optionally at least 80%, preferably at least 85%, more preferably at least 90% and most preferably at least 95%, homologous to a polypeptide having the sequence MDEMGQVGLVGSCMCLGVL-CWPLPKRTSPLELGASPTHVSSTLGPLPPQ (SEQ ID NO: 583) corresponding to amino acids 1-49 of HUMSP18A_P22 (SEQ ID NO:129), a second amino acid sequence being at least 90% homologous to amino acids 66-131 of PSPB_HUMAN (SEQ ID NO:406), which also corresponds to amino acids 50-115 of HUMSP18A_P22 (SEQ ID NO:129), and a third amino acid sequence being at least 70%, optionally at least 80%, preferably at least 85%, more preferably at least 90% and most preferably at least 95% homologous to a polypeptide having the sequence VRAASSPPACLPTQAPVPTHGEPHTQHPSQPDTH-THTHTHTAPKPARHKHTAPQPAGHTHTHTHNT-PAGRTHT HTVPQLAGHTHTQHPIQTHTHTQYPQL-ETHTHTALHPDTYPHSTPASQTHTHTHTHTHTQHTH-STPAGHTHTH THPVHKGPRKLRALQPCTRP-WAPRFRCTRWACTLTHPYTLTLTHMLTHLFILTYML-MLIHTQSRPPALKSPHSPI FAFCPPT (SEQ ID NO: 482) corresponding to amino acids 116-344 of HUMSP18A_P22 (SEQ ID NO:129), wherein said first amino acid sequence, second amino acid sequence and third amino acid sequence are contiguous and in a sequential order.

In some embodiments, this invention provides an isolated polypeptide encoding for an edge portion of HUMSP18A_P22 (SEQ ID NO:129), comprising an amino acid sequence being at least 70%, optionally at least about 80%, preferably at least about 85%, more preferably at least about 90% and most preferably at least about 95% homologous to the sequence VRAASSPPACLPTQAPVPTHGEPH-TQHPSQPDTHTHTHTHTAPKPARHKHTAPQPAGH-THTHTHNTPAGRTHT HTVPQLAGHTHTQHPIQTHTH-TQYPSQLETHTHTALHPDTYPHSTPASQTHTHTH-THTHTQHTHSTPAGHTHTH THPVHKGPRKLRALQ-PCTRPWAPRFRCTRWACTLTHPYTLTLTHML-THLFILTYMLMLIHTQSRPPALKSPHSPI FAFCPPT (SEQ ID NO: 482) of HUMSP18A_P22 (SEQ ID NO:129).

In some embodiments, the isolated chimeric proteins or polypeptides of the invention may comprise an amino acid sequence corresponding to or homologous to that as set forth in HUMSP18A_P38 (SEQ ID NO:130), comprising a first amino acid sequence being at least 90% homologous to amino acids 1-285 of PSPB_HUMAN (SEQ ID NO:406), which also corresponds to amino acids 1-285 of HUMSP18A_P38 (SEQ ID NO:130), and a second amino acid sequence being at least 70%, optionally at least 80%, preferably at least 85%, more preferably at least 90% and most preferably at least 95% homologous to a polypeptide having the sequence SEPTAPSLAQCLLSSSPYPATA (SEQ ID NO: 481) corresponding to amino acids 286-307 of HUMSP18A_P38 (SEQ ID NO:130), wherein said first amino acid sequence and second amino acid sequence are contiguous and in a sequential order.

In some embodiments, this invention provides an isolated polypeptide encoding for an edge portion of HUMSP18A_P38 (SEQ ID NO:130), comprising an amino acid sequence being at least 70%, optionally at least about 80%, preferably at least about 85%, more preferably at least about 90% and most preferably at least about 95% homologous to the sequence SEPTAPSLAQCLLSSSPYPATA (SEQ ID NO: 481) of HUMSP18A_P38 (SEQ ID NO:130).

In some embodiments, the isolated chimeric proteins or polypeptides of the invention may comprise an amino acid sequence corresponding to or homologous to that as set forth in HUMSP18A_P39 (SEQ ID NO:131), comprising a first amino acid sequence being at least 90% homologous to amino acids 1-334 of PSPB_HUMAN (SEQ ID NO:406), which also corresponds to amino acids 1-334 of HUMSP18A_P39 (SEQ ID NO:131), and a second amino acid sequence being at least 70%, optionally at least 80%, preferably at least 85%, more preferably at least 90% and most preferably at least 95% homologous to a polypeptide having the sequence LAPVC (SEQ ID NO: 484) corresponding to amino acids 335-339 of HUMSP18A_P39 (SEQ ID NO:131), wherein said first amino acid sequence and second amino acid sequence are contiguous and in a sequential order.

In some embodiments, this invention provides an isolated polypeptide encoding for an edge portion of HUMSP18A_P39 (SEQ ID NO:131), comprising an amino acid sequence being at least 70%, optionally at least about 80%, preferably at least about 85%, more preferably at least about 90% and most preferably at least about 95% homologous to the sequence LAPVC (SEQ ID NO: 484) of HUMSP18A_P39 (SEQ ID NO:131).

{In some embodiments, the isolated chimeric proteins or polypeptides of the invention may comprise an amino acid sequence corresponding to or homologous to that as set forth in HUMSP18A_P41 (SEQ ID NO:132), comprising a first amino acid sequence being at least 90% homologous to amino acids 1-224 of PSPB_HUMAN (SEQ ID NO:406), which also corresponds to amino acids 1-224 of HUMSP18A_P41 (SEQ ID NO:132), and a second amino acid sequence being at least 70%, optionally at least 80%, preferably at least 85%, more preferably at least 90% and most preferably at least 95% homologous to a polypeptide having the sequence VRHPGPHRAQEHTHTCSSLQLP-PLSQLTPPSGPSWLPEVRRGESRLCIAPTQGTLG-LRLRPGRCQAYSSCNKH (SEQ ID NO: 485) corresponding to amino acids 225-297 of HUMSP18A_P41 (SEQ ID NO:132), wherein said first amino acid sequence and second amino acid sequence are contiguous and in a sequential order.

In some embodiments, this invention provides an isolated polypeptide encoding for an edge portion of HUMSP18A_P41 (SEQ ID NO:132), comprising an amino acid sequence being at least 70%, optionally at least about 80%, preferably at least about 85%, more preferably at least about 90% and most preferably at least about 95% homologous to the sequence VRHPGPHRAQEHTHTCSSLQLP-PLSQLTPPSGPSWLPEVRRGESRLCIAPTQGTLG-LRLRPGRCQAYSSCNKH (SEQ ID NO: 485) of HUMSP18A_P41 (SEQ ID NO:132).

{In some embodiments, the isolated chimeric proteins or polypeptides of the invention may comprise an amino acid sequence corresponding to or homologous to that as set forth in HUMSP18A_P43 (SEQ ID NO:133), comprising a first amino acid sequence being at least 90% homologous to amino acids 1-131 of PSPB_HUMAN (SEQ ID NO:406), which also corresponds to amino acids 1-131 of HUMSP18A_P43 (SEQ ID NO:133), and a second amino acid sequence being at least 70%, optionally at least 80%, preferably at least 85%, more preferably at least 90% and most preferably at least 95% homologous to a polypeptide having the sequence VRAASSPPACLPTQAPVPTHGEPH-TQHPSQPDTHTHTHTHTAPKPARHKHTAPQPAGHTH-THTHNTPAGRTHT HTVPQLAGHTHTQHPIQTHTH-TQYPSQLETHTHTALHPDTYPHSTPASQTHTHTH-THTHTQHTHSTPAGHTHTH THPVHKGPRKL-RALQPCTRPWAPRFRCTRWACTLTHPYTLTLTHM-LTHLFILTYMLMLIHTQSRPPALKSPHSPI FAFCPPT (SEQ ID NO: 482) corresponding to amino acids 132-360 of HUMSP18A_P43 (SEQ ID NO:133), wherein said first amino acid sequence and second amino acid sequence are contiguous and in a sequential order.

In some embodiments, this invention provides an isolated polypeptide encoding for an edge portion of HUMSP18A_P43 (SEQ ID NO:133), comprising an amino acid sequence being at least 70%, optionally at least about 80%, preferably at least about 85%, more preferably at least about 90% and most preferably at least about 95% homologous to the sequence VRAASSPPACLPTQAPVPTHGEPH-TQHPSQPDTHTHTHTHTAPKPARHKHTAPQPAGHTH-THTHNTPAGRTHT HTVPQLAGHTHTQHPIQTHTH-TQYPSQLETHTHTALHPDTYPHSTPASQTHTHTHTH-THTQHTHSTPAGHTHTH THPVHKGPRKLRALQPC-TRPWAPRFRCTRWACTLTHPYTLTLTHMLTHLFILT-YMLMLIHTQSRPPALKSPHSPI FAFCPPT (SEQ ID NO: 482) of HUMSP18A_P43 (SEQ ID NO:133).

In some embodiments, the isolated chimeric proteins or polypeptides of the invention may comprise an amino acid sequence corresponding to or homologous to that as set forth in HUMSP18A_P45 (SEQ ID NO:134), comprising a first amino acid sequence being at least 90% homologous to amino acids 1-65 of PSPB_HUMAN (SEQ ID NO:406), which also corresponds to amino acids 1-65 of HUMSP18A_P45 (SEQ ID NO:134), a second amino acid sequence being at least 70%, optionally at least 80%, preferably at least 85%, more preferably at least 90% and most preferably at least 95% homologous to a polypeptide having the sequence RTSPLELGASPTHVSSTLGPLPPQ (SEQ ID NO: 487) corresponding to amino acids 66-89 of HUMSP18A_P45 (SEQ ID NO:134), and a third amino acid sequence being at least 90% homologous to amino acids 66-381 of PSPB_HUMAN (SEQ ID NO:406), which also corresponds to amino acids 90-405 of HUMSP18A_P45 (SEQ ID NO:134), wherein said first amino acid sequence, second amino acid sequence and third amino acid sequence are contiguous and in a sequential order.

In some embodiments, this invention provides an isolated polypeptide encoding for an edge portion of HUMSP18A_P45 (SEQ ID NO:134), comprising an amino acid sequence being at least 70%, optionally at least about 80%, preferably at least about 85%, more preferably at least about 90% and most preferably at least about 95% homologous to the sequence RTSPLELGASPTHVSSTLGPLPPQ (SEQ ID NO: 487) of HUMSP18A_P45 (SEQ ID NO:134).

In some embodiments, the isolated chimeric proteins or polypeptides of the invention may comprise an amino acid sequence corresponding to or homologous to that as set forth in HUMSP18A_P48 (SEQ ID NO:135), comprising a first amino acid sequence being at least 90% homologous to amino acids 1-225 of PSPB_HUMAN (SEQ ID NO:406), which also corresponds to amino acids 1-225 of HUMSP18A_P48 (SEQ ID NO:135), and a second amino acid sequence being at least 70%, optionally at least 80%, preferably at least 85%, more preferably at least 90% and most preferably at least 95% homologous to a polypeptide having the sequence RRQENGCRETLSATSACP (SEQ ID NO: 488) corresponding to amino acids 226-243 of HUMSP18A_P48 (SEQ ID NO:135), wherein said first amino acid sequence and second amino acid sequence are contiguous and in a sequential order.

In some embodiments, this invention provides an isolated polypeptide encoding for an edge portion of HUMSP18A_P48 (SEQ ID NO:135), comprising an amino acid sequence being at least 70%, optionally at least about 80%, preferably at least about 85%, more preferably at least about 90% and most preferably at least about 95% homologous to the sequence RRQENGCRETLSATSACP (SEQ ID NO: 488) of HUMSP18A_P48 (SEQ ID NO:135).

In some embodiments, the isolated chimeric proteins or polypeptides of the invention may comprise an amino acid sequence corresponding to or homologous to that as set forth in HUMSP18A_P49 (SEQ ID NO:136), comprising a first amino acid sequence being at least 90% homologous to amino acids 1-361 of PSPB_HUMAN (SEQ ID NO:406), which also corresponds to amino acids 1-361 of HUMSP18A_P49 (SEQ ID NO:136), and a second amino acid sequence being at least 70%, optionally at least 80%, preferably at least 85%, more preferably at least 90% and most preferably at least 95% homologous to a polypeptide having the sequence KKTPSFKVLQYGQTWWLTPAIPAP (SEQ ID NO: 489) corresponding to amino acids 362-385 of HUMSP18A_P49 (SEQ ID NO:136), wherein said first amino acid sequence and second amino acid sequence are contiguous and in a sequential order.

In some embodiments, this invention provides an isolated polypeptide encoding for an edge portion of HUMSP18A_P49 (SEQ ID NO:136), comprising an amino acid sequence being at least 70%, optionally at least about 80%, preferably at least about 85%, more preferably at least about 90% and most preferably at least about 95% homologous to the sequence KKTPSFKVLQYGQTWWLTPAIPAP (SEQ ID NO: 489) of HUMSP18A_P49 (SEQ ID NO:136).

In some embodiments, the isolated chimeric proteins or polypeptides of the invention may comprise an amino acid sequence corresponding to or homologous to that as set forth in HUMSP18A_P50 (SEQ ID NO:137), comprising a first amino acid sequence being at least 90% homologous to amino acids 1-194 of PSPB_HUMAN (SEQ ID NO:406), which also corresponds to amino acids 1-194 of HUMSP18A_P50 (SEQ ID NO:137), and a second amino acid sequence being at least 90% homologous to amino acids 225-381 of PSPB_HUMAN (SEQ ID NO:406), which also corresponds to amino acids 195-351 of HUMSP18A_P50 (SEQ ID NO:137), wherein said first amino acid sequence and second amino acid sequence are contiguous and in a sequential order.

In some embodiments, this invention provides an isolated chimeric polypeptide encoding for an edge portion of HUMSP18A_P50 (SEQ ID NO:137), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 194−x to 194; and ending at any of amino acid numbers 195+((n−2)−x), in which x varies from 0 to n−2.

In some embodiments, the isolated chimeric proteins or polypeptides of the invention may comprise an amino acid sequence corresponding to or homologous to that as set forth in HUMSP18A_P53 (SEQ ID NO:138), comprising a first amino acid sequence being at least 90% homologous to amino acids 1-89 of PSPB_HUMAN (SEQ ID NO:406), which also corresponds to amino acids 1-89 of HUMSP18A_P53 (SEQ ID NO:138), and a second amino acid sequence being at least 90% homologous to amino acids 132-381 of PSPB_HUMAN (SEQ ID NO:406), which also corresponds to amino acids 90-339 of HUMSP18A_P53 (SEQ ID NO:138), wherein said first amino acid sequence and second amino acid sequence are contiguous and in a sequential order.

In some embodiments, this invention provides an isolated chimeric polypeptide encoding for an edge portion of HUMSP18A_P53 (SEQ ID NO:138), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QD, having a structure as follows: a sequence starting from any of amino acid numbers 89−x to 89; and ending at any of amino acid numbers 90+((n−2)−x), in which x varies from 0 to n−2.

In some embodiments, the isolated chimeric proteins or polypeptides of the invention may comprise an amino acid sequence corresponding to or homologous to that as set forth in F05068_P6 (SEQ ID NO:193), comprising a first amino acid sequence being at least 90% homologous to amino acids 1-83 of ADML_HUMAN (SEQ ID NO:413), which also corresponds to amino acids 1-83 of F05068_P6 (SEQ ID NO:193), and a second amino acid sequence being at least 70%, optionally at least 80%, preferably at least 85%, more preferably at least 90% and most preferably at least 95% homologous to a polypeptide having the sequence CLSSPSRPQQSGCRPHPSQALPPE-HEQLPGPPELWLPLRDVHGAEAGTPDLPVHR (SEQ ID NO: 490) corresponding to amino acids 84-139 of F05068_P6 (SEQ ID NO:193), wherein said first amino acid sequence and second amino acid sequence are contiguous and in a sequential order.

In some embodiments, this invention provides an isolated polypeptide encoding for an edge portion of F05068_P6 (SEQ ID NO:193), comprising an amino acid sequence being at least 70%, optionally at least about 80%, preferably at least about 85%, more preferably at least about 90% and most preferably at least about 95% homologous to the sequence CLSSPSRPQQSGCRPHPSQALPPEHEQLPGPPEL-WLPLRDVHGAEAGTPDLPVHR (SEQ ID NO: 490) of F05068_P6 (SEQ ID NO:193).

In some embodiments, the isolated chimeric proteins or polypeptides of the invention may comprise an amino acid sequence corresponding to or homologous to that as set forth in F05068_P9 (SEQ ID NO:194), comprising a amino acid sequence being at least 90% homologous to amino acids 1-33 of ADML_HUMAN (SEQ ID NO:413), which also corresponds to amino acids 1-33 of F05068_P9 (SEQ ID NO:194).

In some embodiments, the isolated chimeric proteins or polypeptides of the invention may comprise an amino acid sequence corresponding to or homologous to that as set forth in F05068_P10 (SEQ ID NO:195), comprising a first amino acid sequence being at least 90% homologous to amino acids 1-82 of ADML_HUMAN (SEQ ID NO:413), which also corresponds to amino acids 1-82 of F05068_P10 (SEQ ID NO:195), and an amino acid R, wherein said first amino acid sequence and said amino acid are contiguous and in a sequential order.

In some embodiments, the isolated chimeric proteins or polypeptides of the invention may comprise an amino acid sequence corresponding to or homologous to that as set forth in HUMIL10_P6 (SEQ ID NO:215), comprising an amino acid sequence being at least 90% homologous to amino acids 86-178 of IL10_HUMAN (SEQ ID NO:423), which also corresponds to amino acids 1-93 of HUMIL10_P6 (SEQ ID NO:215).

In some embodiments, the isolated chimeric proteins or polypeptides of the invention may comprise an amino acid sequence corresponding to or homologous to that as set forth in HUMIL10_P6 (SEQ ID NO:215), comprising a first amino acid sequence being at least 90% homologous to amino acids 86-126 of Q6FGS9_HUMAN (SEQ ID NO: 545), which also corresponds to amino acids 1-41 of HUMIL10_P6 (SEQ ID NO:215), a bridging amino acid H corresponding to amino acid 42 of HUMIL10_P6 (SEQ ID NO:215), and a second amino acid sequence being at least 90% homologous to amino acids 128-178 of Q6FGS9_HUMAN (SEQ ID NO: 545), which also corresponds to amino acids 43-93 of HUMIL10_P6 (SEQ ID NO:215), wherein said first amino acid sequence, bridging amino acid and second amino acid sequence are contiguous and in a sequential order.

In some embodiments, the isolated chimeric proteins or polypeptides of the invention may comprise an amino acid sequence corresponding to or homologous to that as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTF-SFLPQ (SEQ ID NO: 584) corresponding to amino acids 1-28 of HUMIL10_P9 (SEQ ID NO:216), and a second amino acid sequence being at least 90% homologous to amino acids 127-178 of IL10_HUMAN (SEQ ID NO:423), which also corresponds to amino acids 29-80 of HUMIL10_P9 (SEQ ID NO:216), wherein said first amino acid sequence and second amino acid sequence are contiguous and in a sequential order.

In some embodiments, this invention provides an isolated polypeptide encoding for a head of HUMIL10_P9 (SEQ ID NO:216), comprising a polypeptide being at least 70%, optionally at least about 80%, preferably at least about 85%, more preferably at least about 90% and most preferably at least about 95% homologous to the sequence MMPPACPLS-VMDMELEARITNTFSFLPQ (SEQ ID NO: 584) of HUMIL10_P9 (SEQ ID NO:216).

In some embodiments, the isolated chimeric proteins or polypeptides of the invention may comprise an amino acid sequence corresponding to or homologous to that as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTF-SFLPQ (SEQ ID NO: 584) corresponding to amino acids 1-28 of HUMIL10_P9 (SEQ ID NO:216), and a second amino acid sequence being at least 90% homologous to amino acids 109-160 of Q71UZ1_HUMAN (SEQ ID NO: 542), which also corresponds to amino acids 29-80 of HUMIL10_P9 (SEQ ID NO:216), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTF-SFLPQH (SEQ ID NO: 585) corresponding to amino acids 1-29 of HUMIL10_P9 (SEQ ID NO:216), and a second amino acid sequence being at least 90% homologous to amino acids 128-178 of Q6FGS9_HUMAN (SEQ ID NO: 545), which also corresponds to amino acids 30-80 of HUMIL10_P9 (SEQ ID NO:216), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HUMIL10_P10 (SEQ ID NO:217), comprising a first amino acid sequence being at least 90% homologous to amino acids 1-50 of IL10_HUMAN (SEQ ID NO:423), which also corresponds to amino acids 1-50 of HUMIL10_P10 (SEQ ID NO:217), and a second amino acid sequence being at least 90% homologous to QMKDQLDN-LLLKESLLEDFKGYLGCQALSEMIQFYLEEVMPQ-AENQDPDIKAHVNSLGENLKTLRLRLRRCHR FLPC-ENKSKAVEQVKNAFNKLQEKGIYKAMSEFDIFINYI-EAYMTMKIRN (SEQ ID NO: 491) corresponding to amino acids 56-178 of IL10_HUMAN (SEQ ID NO:423), which also corresponds to amino acids 51-173 of HUMIL10_P10 (SEQ ID NO:217), wherein said first amino acid sequence and second amino acid sequence are contiguous and in a sequential order.

In some embodiments, this invention provides an isolated chimeric polypeptide encoding for an edge portion of HUMIL10_P10 (SEQ ID NO:217), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RQ, having a structure as follows: a sequence starting from any of amino acid numbers 50-x to 50; and ending at any of amino acid numbers 51+ ((n−2)−x), in which x varies from 0 to n−2.

In some embodiments, the isolated chimeric proteins or polypeptides of the invention may comprise an amino acid sequence corresponding to or homologous to that as set forth in HUMIL10_P10 (SEQ ID NO:217), comprising a first amino acid sequence being at least 90% homologous to amino acids 1-50 of Q6FGW4_HUMAN (SEQ ID NO: 543), which also corresponds to amino acids 1-50 of HUMIL10_P10 (SEQ ID NO:217), and a second amino acid sequence being at least 90% homologous to QMKDQLDN-LLLKESLLEDFKGYLGCQALSEMIQFYLEEVMPQ-AENQDPDIKAHVNSLGENLKTLRLRLRRCHR FLPC-ENKSKAVEQVKNAFNKLQEKGIYKAMSEFDIFINY-IEAYMTMKIRN (SEQ ID NO: 491) corresponding to amino acids 56-178 of Q6FGW4_HUMAN (SEQ ID NO: 543), which also corresponds to amino acids 51-173 of HUMIL10_P10 (SEQ ID NO:217), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in HUMIL10_P10 (SEQ ID NO:217), comprising a first amino acid sequence being at least 90% homologous to amino acids 1-50 of Q6FGS9_HUMAN (SEQ ID NO: 545), which also corresponds to amino acids 1-50 of HUMIL10_P10 (SEQ ID NO:217), a second amino acid sequence being at least 90% homologous to amino acids 56-126 of Q6FGS9_HUMAN (SEQ ID NO: 545), which also corresponds to amino acids 51-121 of HUMIL10_P10 (SEQ ID NO:217), a bridging amino acid H corresponding to amino acid 122 of HUMIL10_P10 (SEQ ID NO:217), and a third amino acid sequence being at least 90% homologous to amino acids 128-178 of Q6FGS9_HUMAN (SEQ ID NO: 545), which also corresponds to amino acids 123-173 of HUMIL10_P10 (SEQ ID NO:217), wherein said first amino acid sequence, second amino acid sequence, bridging amino acid and third amino acid sequence are contiguous and in a sequential order.

In some embodiments, the isolated chimeric proteins or polypeptides of the invention may comprise an amino acid sequence corresponding to or homologous to that as set forth in HUMIL10_P10 (SEQ ID NO:217), comprising a first amino acid sequence being at least 70%, optionally at least 80%, preferably at least 85%, more preferably at least 90% and most preferably at least 95%, homologous to a polypeptide having the sequence MHSSALLCCLVLLTGVRA (SEQ ID NO: 586) corresponding to amino acids 1-18 of HUMIL10_P10 (SEQ ID NO:217), a second amino acid sequence being at least 90% homologous to amino acids 1-32 of Q71UZ1_HUMAN (SEQ ID NO: 542), which also corresponds to amino acids 19-50 of HUMIL10_P10 (SEQ ID NO:217), and a third amino acid sequence being at least 90% homologous to QMKDQLDNLLLKESLLEDFKGYLGC-QALSEMIQFYLEEVMPQAENQDPDIKAHVNSLGE-NLKTLRLRLRRCHR FLPCENKSKAVEQVK-NAFNKLQEKGIYKAMSEFDIFINYIEAYMTMKIRN (SEQ ID NO: 491) corresponding to amino acids 38-160 of Q71UZ1_HUMAN (SEQ ID NO: 542), which also corresponds to amino acids 51-173 of HUMIL10_P10 (SEQ ID NO:217), wherein said first amino acid sequence, second amino acid sequence and third amino acid sequence are contiguous and in a sequential order.

In some embodiments, this invention provides an isolated polypeptide encoding for a head of HUMIL10_P10 (SEQ ID NO:217), comprising a polypeptide being at least 70%, optionally at least about 80%, preferably at least about 85%, more preferably at least about 90% and most preferably at least about 95% homologous to the sequence MHSSAL-LCCLVLLTGVRA (SEQ ID NO: 586) of HUMIL10_P10 (SEQ ID NO:217).

In some embodiments, the isolated chimeric proteins or polypeptides of the invention may comprise an amino acid sequence corresponding to or homologous to that as set forth in HUMIL10_P10 (SEQ ID NO:217), comprising a first amino acid sequence being at least 90% homologous to amino acids 1-50 of Q6LBF4_HUMAN (SEQ ID NO: 546), which also corresponds to amino acids 1-50 of HUMIL10_P10 (SEQ ID NO:217), and a second amino acid sequence being at least 70%, optionally at least 80%, preferably at least 85%, more preferably at least 90% and most preferably at least 95% homologous to a polypeptide having the sequence QMKDQLDNLLLKESLLEDFKGYLGC-QALSEMIQFYLEEVMPQAENQDPDIKAHVNSLGEN-LKTLRLRLRRCHR FLPCENKSKAVEQVKNAFNKL-QEKGIYKAMSEFDIFINYIEAYMTMKIRN (SEQ ID NO: 491) corresponding to amino acids 51-173 of HUMIL10_P10 (SEQ ID NO:217), wherein said first amino acid sequence and second amino acid sequence are contiguous and in a sequential order.

In some embodiments, this invention provides an isolated polypeptide encoding for an edge portion of HUMIL10_P10 (SEQ ID NO:217), comprising an amino acid sequence being at least 70%, optionally at least about 80%, preferably at least about 85%, more preferably at least about 90% and most preferably at least about 95% homologous to the sequence QMKDQLDNLLLKESLLEDFKGYLGCQALSEMIQF-YLEEVMPQAENQDPDIKAHVNSLGENLKTLRLRL-RRCHR FLPCENKSKAVEQVKNAFNKLQEK-GIYKAMSEFDIFINYIEAYMTMKIRN (SEQ ID NO: 491) of HUMIL10_P10 (SEQ ID NO:217).

In some embodiments, the isolated chimeric proteins or polypeptides of the invention may comprise an amino acid sequence corresponding to or homologous to that as set forth in HUMIL10_P12 (SEQ ID NO:218), comprising a first amino acid sequence being at least 90% homologous to amino acids 1-126 of IL10_HUMAN (SEQ ID NO:423), which also corresponds to amino acids 1-126 of HUMIL10_P12 (SEQ ID NO:218), and a second amino acid sequence being at least 90% homologous to LQEKGIYKA-MSEFDIFINYIEAYMTMKIRN corresponding to amino acids 149-178 of IL10_HUMAN (SEQ ID NO:423), which also corresponds to amino acids 127-156 of HUMIL10_P12 (SEQ ID NO:218), wherein said first amino acid sequence and second amino acid sequence are contiguous and in a sequential order.

In some embodiments, this invention provides an isolated chimeric polypeptide encoding for an edge portion of HUMIL10_P12 (SEQ ID NO:218), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CL, having a structure as follows: a sequence starting from any of amino acid numbers 126−x to 126; and ending at any of amino acid numbers 127+((n−2)−x), in which x varies from 0 to n−2.

In some embodiments, the isolated chimeric proteins or polypeptides of the invention may comprise an amino acid sequence corresponding to or homologous to that as set forth in HUMIL10_P12 (SEQ ID NO:218), comprising a first amino acid sequence being at least 70%, optionally at least 80%, preferably at least 85%, more preferably at least 90% and most preferably at least 95%, homologous to a polypeptide having the sequence MHSSALLCCLVLLTGVRA (SEQ ID NO: 586) corresponding to amino acids 1-18 of HUMIL10_P12 (SEQ ID NO:218), a second amino acid sequence being at least 90% homologous to amino acids 1-108 of Q71UZ1_HUMAN (SEQ ID NO: 542), which also corresponds to amino acids 19-126 of HUMIL10_P12 (SEQ ID NO:218), and a third amino acid sequence being at least 90% homologous to LQEKGIYKAMSEFDIFINYIEAYMT-MKIRN corresponding to amino acids 131-160 of Q71UZ1_HUMAN (SEQ ID NO: 542), which also corresponds to amino acids 127-156 of HUMIL10_P12 (SEQ ID NO:218), wherein said first amino acid sequence, second amino acid sequence and third amino acid sequence are contiguous and in a sequential order.

In some embodiments, this invention provides an isolated polypeptide encoding for a head of HUMIL10_P12 (SEQ ID NO:218), comprising a polypeptide being at least 70%, optionally at least about 80%, preferably at least about 85%, more preferably at least about 90% and most preferably at least about 95% homologous to the sequence MHSSAL-LCCLVLLTGVRA (SEQ ID NO: 586) of HUMIL10_P12 (SEQ ID NO:218).

In some embodiments, this invention provides an isolated chimeric polypeptide encoding for an edge portion of HUMIL10_P12 (SEQ ID NO:218), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CL, having a structure as follows: a sequence starting from any of amino acid numbers 126−x to 126; and ending at any of amino acid numbers 127+((n−2)−x), in which x varies from 0 to n−2.

In some embodiments, the isolated chimeric proteins or polypeptides of the invention may comprise an amino acid sequence corresponding to or homologous to that as set forth in HUMIL10_P12 (SEQ ID NO:218), comprising a first amino acid sequence being at least 90% homologous to MHSSALLCCLVLLTGVRASPGQGTQSEN-SCTHFPGNLPNMLRDLRDAFSRVKTFF corresponding to amino acids 1-55 of Q6LBF4_HUMAN (SEQ ID NO: 546), which also corresponds to amino acids 1-55 of HUMIL10_P12 (SEQ ID NO:218), and a second amino acid sequence being at least 70%, optionally at least 80%, preferably at least 85%, more preferably at least 90% and most preferably at least 95% homologous to a polypeptide having the sequence QMKDQLDNLLLKESLLEDFKGYLGC-QALSEMIQFYLEEVMPQAENQDPDIKAH-VNSLGENLKTLRLRLRRCLQ EKGIYKAMSEFDIFI-NYIEAYMTMKIRN (SEQ ID NO: 492) corresponding to amino acids 56-156 of HUMIL10_P12 (SEQ ID NO:218), wherein said first amino acid sequence and second amino acid sequence are contiguous and in a sequential order.

In some embodiments, this invention provides an isolated polypeptide as set forth in a tail of HUMIL10_P12 (SEQ ID NO:218), comprising a polypeptide being at least 70%, optionally at least about 80%, preferably at least about 85%, more preferably at least about 90% and most preferably at least about 95% homologous to the sequence QMKDQLDN-LLLKESLLEDFKGYLGCQALSEMIQFYLEEVMPQA-ENQDPDIKAHVNSLGENLKTLRLRLRRCLQ EKGIY-KAMSEFDIFINYIEAYMTMKIRN (SEQ ID NO: 492) of HUMIL10_P12 (SEQ ID NO:218).

In some embodiments, the isolated chimeric proteins or polypeptides of the invention may comprise an amino acid sequence corresponding to or homologous to that as set forth in HUMIL10_P13 (SEQ ID NO:219), comprising a first amino acid sequence being at least 70%, optionally at least 80%, preferably at least 85%, more preferably at least 90% and most preferably at least 95%, homologous to a polypeptide having the sequence MPPACPLSVMDMELEARIT- NTFSFLPQ (SEQ ID NO: 587) corresponding to amino acids 1-27 of HUMIL10_P13 (SEQ ID NO:219), and a second amino acid sequence being at least 90% homologous to amino acids 127-178 of IL10_HUMAN (SEQ ID NO:423), which also corresponds to amino acids 28-79 of HUMIL10_P13 (SEQ ID NO:219), wherein said first amino acid sequence and second amino acid sequence are contiguous and in a sequential order.

In some embodiments, this invention provides an isolated polypeptide encoding for a head of HUMIL10_P13 (SEQ ID NO:219), comprising a polypeptide being at least 70%, optionally at least about 80%, preferably at least about 85%, more preferably at least about 90% and most preferably at least about 95% homologous to the sequence MPPACPLSVMDMELEARITNTFSFLPQ (SEQ ID NO: 587) of HUMIL10_P13 (SEQ ID NO:219).

In some embodiments, the isolated chimeric proteins or polypeptides of the invention may comprise an amino acid sequence corresponding to or homologous to that as set forth in HUMIL10_P13 (SEQ ID NO:219), comprising a first amino acid sequence being at least 70%, optionally at least 80%, preferably at least 85%, more preferably at least 90% and most preferably at least 95%, homologous to a polypeptide having the sequence MPPACPLSVMDMELEARITNTFSFLPQ (SEQ ID NO: 587) corresponding to amino acids 1-27 of HUMIL10_P13 (SEQ ID NO:219), and a second amino acid sequence being at least 90% homologous to amino acids 109-160 of Q71UZ1_HUMAN (SEQ ID NO: 542), which also corresponds to amino acids 28-79 of HUMIL10_P13 (SEQ ID NO:219), wherein said first amino acid sequence and second amino acid sequence are contiguous and in a sequential order.

In some embodiments, the isolated chimeric proteins or polypeptides of the invention may comprise an amino acid sequence corresponding to or homologous to that as set forth in AA336074_P30 (SEQ ID NO:236), comprising a first amino acid sequence being at least 90% homologous to amino acids 1-158 of KLK4_HUMAN (SEQ ID NO:430), which also corresponds to amino acids 1-158 of AA336074_P30 (SEQ ID NO:236), and a second amino acid sequence being at least 70%, optionally at least 80%, preferably at least 85%, more preferably at least 90% and most preferably at least 95% homologous to a polypeptide having the sequence DAVIAIQSQTVGGWECEKLSQPWQGCTISATSSARTSCCILTGCSLLL-TASPGVEIRRDSAGCSHMIKEGPELGV TPDPS (SEQ ID NO: 493) corresponding to amino acids 159-238 of AA336074_P30 (SEQ ID NO:236), wherein said first amino acid sequence and second amino acid sequence are contiguous and in a sequential order.

In some embodiments, this invention provides an isolated polypeptide encoding for an edge portion of AA336074_P30 (SEQ ID NO:236), comprising an amino acid sequence being at least 70%, optionally at least about 80%, preferably at least about 85%, more preferably at least about 90% and most preferably at least about 95% homologous to the sequence DAVIAIQSQTVGGWECEKLSQPWQGCTISATSSARTSCCILTGCSLLLTASPGVEIRRDSAGCSHMIKEGPELGV TPDPS (SEQ ID NO: 493) of AA336074_P30 (SEQ ID NO:236).

In some embodiments, the isolated chimeric proteins or polypeptides of the invention may comprise an amino acid sequence corresponding to or homologous to that as set forth in Z39737_P9 (SEQ ID NO:307), comprising a first amino acid sequence being at least 90% homologous to amino acids 1-136 of SPO2_HUMAN_V1, which also corresponds to amino acids 1-136 of Z39737_P9 (SEQ ID NO:307), and a second amino acid sequence being at least 70%, optionally at least 80%, preferably at least 85%, more preferably at least 90% and most preferably at least 95% homologous to a polypeptide having the sequence FLQQGCPPSPGVPTGF-PGASYSATMWEFHHHRDLSGSSGSYVETRNSSP (SEQ ID NO: 494) corresponding to amino acids 137-185 of Z39737_P9 (SEQ ID NO:307), wherein said first amino acid sequence and second amino acid sequence are contiguous and in a sequential order.

In some embodiments, this invention provides an isolated polypeptide encoding for an edge portion of Z39737_P9 (SEQ ID NO:307), comprising an amino acid sequence being at least 70%, optionally at least about 80%, preferably at least about 85%, more preferably at least about 90% and most preferably at least about 95% homologous to the sequence FLQQGCPPSPGVPTGFPGASYSATMWEF-HHHRDLSGSSGSYVETRNSSP (SEQ ID NO: 494) of Z39737_P9 (SEQ ID NO:307).

In some embodiments, the isolated chimeric proteins or polypeptides of the invention may comprise an amino acid sequence corresponding to or homologous to that as set forth in Z25299_P1 (SEQ ID NO:345), comprising a first amino acid sequence being at least 90% homologous to amino acids 1-131 of ALK1_HUMAN (SEQ ID NO:443), which also corresponds to amino acids 1-131 of Z25299_P1 (SEQ ID NO:345), and a second amino acid sequence being at least 70%, optionally at least 80%, preferably at least 85%, more preferably at least 90% and most preferably at least 95% homologous to a polypeptide having the sequence GKQGMRAH (SEQ ID NO: 495) corresponding to amino acids 132-139 of Z25299_P1 (SEQ ID NO:345), wherein said first amino acid sequence and second amino acid sequence are contiguous and in a sequential order.

In some embodiments, this invention provides an isolated polypeptide encoding for an edge portion of Z25299_P1 (SEQ ID NO:345), comprising an amino acid sequence being at least 70%, optionally at least about 80%, preferably at least about 85%, more preferably at least about 90% and most preferably at least about 95% homologous to the sequence GKQGMRAH (SEQ ID NO: 495) of Z25299_P1 (SEQ ID NO:345).

In some embodiments, the isolated chimeric proteins or polypeptides of the invention may comprise an amino acid sequence corresponding to or homologous to that as set forth in Z25299_P4 (SEQ ID NO:346), comprising a first amino acid sequence being at least 90% homologous to amino acids 1-131 of ALK1_HUMAN (SEQ ID NO:443), which also corresponds to amino acids 1-131 of Z25299_P4 (SEQ ID NO:346), and a second amino acid sequence being at least 70%, optionally at least 80%, preferably at least 85%, more preferably at least 90% and most preferably at least 95% homologous to a polypeptide having the sequence GCFSP-SISPSHFFTMSSISTFSAVLRTSASSL-SACVLPATHQMRSGEEFSTFGFMLVLK (SEQ ID NO: 496) corresponding to amino acids 132-190 of Z25299_P4 (SEQ ID NO:346), wherein said first amino acid sequence and second amino acid sequence are contiguous and in a sequential order.

In some embodiments, this invention provides an isolated polypeptide encoding for an edge portion of Z25299_P4 (SEQ ID NO:346), comprising an amino acid sequence being at least 70%, optionally at least about 80%, preferably at least about 85%, more preferably at least about 90% and most preferably at least about 95% homologous to the sequence GCFSPSISPSHFFTMSSISTFSAVLRTSASSLSACVLPA-THQMRSGEEFSTFGFMLVLK (SEQ ID NO: 496) of Z25299_P4 (SEQ ID NO:346).

In some embodiments, the isolated chimeric proteins or polypeptides of the invention may comprise an amino acid sequence corresponding to or homologous to that as set forth in Z25299_P5 (SEQ ID NO:347), comprising a first amino acid sequence being at least 90% homologous to amino acids 1-131 of ALK1_HUMAN (SEQ ID NO:443), which also corresponds to amino acids 1-131 of Z25299_P5 (SEQ ID NO:347), and a second amino acid sequence being at least 70%, optionally at least 80%, preferably at least 85%, more preferably at least 90% and most preferably at least 95% homologous to a polypeptide having the sequence GEKRHHKQLRDQEVDPLEMRRHSAG (SEQ ID NO: 497) corresponding to amino acids 132-156 of Z25299_P5 (SEQ ID NO:347), wherein said first amino acid sequence and second amino acid sequence are contiguous and in a sequential order.

In some embodiments, this invention provides an isolated polypeptide encoding for an edge portion of Z25299_P5 (SEQ ID NO:347), comprising an amino acid sequence being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 497) of Z25299_P5 (SEQ ID NO:347).

In some embodiments, the isolated chimeric proteins or polypeptides of the invention may comprise an amino acid sequence corresponding to or homologous to that as set forth in Z25299_P6 (SEQ ID NO:348), comprising a first amino acid sequence being at least 90% homologous to amino acids 1-81 of NP_003055 (SEQ ID NO: 550), which also corresponds to amino acids 1-81 of Z25299_P6 (SEQ ID NO:348), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 498) corresponding to amino acids 82-89 of Z25299_P6 (SEQ ID NO:348), wherein said first amino acid sequence and second amino acid sequence are contiguous and in a sequential order.

In some embodiments, this invention provides an isolated polypeptide encoding for an edge portion of Z25299_P6 (SEQ ID NO:348), comprising an amino acid sequence being at least 70%, optionally at least about 80%, preferably at least about 85%, more preferably at least about 90% and most preferably at least about 95% homologous to the sequence RGSLGSAQ (SEQ ID NO: 498) of Z25299_P6 (SEQ ID NO:348).

In some embodiments, the isolated chimeric proteins or polypeptides of the invention may comprise an amino acid sequence corresponding to or homologous to that as set forth in Z25299_P8 (SEQ ID NO:349), comprising a amino acid sequence being at least 90% homologous to amino acids 1-82 of ALK1_HUMAN (SEQ ID NO:443), which also corresponds to amino acids 1-82 of Z25299_P8 (SEQ ID NO:349), wherein said and first amino acid sequence are contiguous and in a sequential order.

In some embodiments, this invention provides an isolated chimeric polypeptide encoding for an edge portion of Z25299_P8 (SEQ ID NO:349), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise T, having a structure as follows: a sequence starting from any of amino acid numbers 82-x to 82; and ending at any of amino acid numbers 82+ ((n−2)−x), in which x varies from 0 to n−2.

In some embodiments, the isolated chimeric proteins or polypeptides of the invention may comprise an amino acid sequence corresponding to or homologous to that as set forth in Z22012_P41 (SEQ ID NO:254), comprising a first amino acid sequence being at least 90% homologous to amino acids 1-125 of L3BP_HUMAN (SEQ ID NO: 441), which also corresponds to amino acids 1-125 of Z22012_P41 (SEQ ID NO:254), and a second amino acid sequence being at least 70%, optionally at least 80%, preferably at least 85%, more preferably at least 90% and most preferably at least 95% homologous to a polypeptide having the sequence GAPTPWTSPGSSRRPLARSLTASGAATCPSA (SEQ ID NO: 499) corresponding to amino acids 126-156 of Z22012_P41 (SEQ ID NO:254), wherein said first amino acid sequence and second amino acid sequence are contiguous and in a sequential order.

In some embodiments, this invention provides an isolated polypeptide encoding for an edge portion of Z22012_P41 (SEQ ID NO:254), comprising an amino acid sequence being at least 70%, optionally at least about 80%, preferably at least about 85%, more preferably at least about 90% and most preferably at least about 95% homologous to the sequence GAPTPWTSPGSSRRPLARSLTASGAATCPSA (SEQ ID NO: 499) of Z22012_P41 (SEQ ID NO:254).

In some embodiments, the isolated chimeric proteins or polypeptides of the invention may comprise an amino acid sequence corresponding to or homologous to that as set forth in Z22012_P41 (SEQ ID NO:254), comprising a first amino acid sequence being at least 70%, optionally at least 80%, preferably at least 85%, more preferably at least 90% and most preferably at least 95%, homologous to a polypeptide having the sequence MTPPRLFWVWLLVAGTQ-GVNDGDMRLADGGATNQGRVEIFYRGQWGTV-CDNLWDLTDASVVCRALGFENA TQALGRAAFGQ-GSGPIMLDEVQCTGTEASLADCKSLGWLKSNCR-HERDAGVVCTNGAPTPWTSPGSSRRPLA RSLTAS-GAATCPSA (SEQ ID NO: 589) corresponding to amino acids 126-156 of Z22012_P41 (SEQ ID NO:254), and a second amino acid sequence being at least 90% homologous to amino acids 1-125 of NP_005558 (SEQ ID NO: 551), which also corresponds to amino acids 1-125 of Z22012_P41 (SEQ ID NO:254), wherein said first amino acid sequence and second amino acid sequence are contiguous and in a sequential order.

In some embodiments, this invention provides an isolated polypeptide encoding for a head of Z22012_P41 (SEQ ID NO:254), comprising a polypeptide being at least 70%, optionally at least about 80%, preferably at least about 85%, more preferably at least about 90% and most preferably at least about 95% homologous to the sequence MTPPRLF-WVWLLVAGTQGVNDGDMRLADGGATNQGRVEIFY-RGQWGTVCDNLWDLTDASVVCRALGFENA TQAL-GRAAFGQGSGPIMLDEVQCTGTEASLADCKSLGWL-KSNCRHERDAGVVCTNGAPTPWTSPGSSRRPLA RSLTASGAATCPSA (SEQ ID NO: 589) of Z22012_P41 (SEQ ID NO:254).

In some embodiments, the isolated chimeric proteins or polypeptides of the invention may comprise an amino acid sequence corresponding to or homologous to that as set forth in Z22012_P42 (SEQ ID NO:255), comprising a first amino acid sequence being at least 70%, optionally at least 80%, preferably at least 85%, more preferably at least 90% and most preferably at least 95%, homologous to a polypeptide having the sequence MTPPRLFWVWLLVAGTQG-VNDGDMRLADGGATNQGRVEIFYRGQWGTVCD- NLWDLTDASVVCRALGFENA TQALGRAAFGQGSG-PIMLDEVQCTGTEASLADCKSLGWLKSNCRHERD-AGVVCTNGTSTPEGLTSPCRQSSAS TSWPLPMGPGS-CRATAQASLPSSSPRTPRSRCPWTCMPMQWPQGTPC-WRSSAYSSWPGTSRP (SEQ ID NO: 590) corresponding to amino acids 126-205 of Z22012_P42 (SEQ ID NO:255), and a second amino acid sequence being at least 90% homologous to amino acids 1-125 of L3BP_HUMAN (SEQ ID NO: 441), which also corresponds to amino acids 1-125 of Z22012_P42 (SEQ ID NO:255), wherein said first amino acid sequence and second amino acid sequence are contiguous and in a sequential order.

In some embodiments, this invention provides an isolated polypeptide encoding for a head of Z22012_P42 (SEQ ID NO:255), comprising a polypeptide being at least 70%, optionally at least about 80%, preferably at least about 85%, more preferably at least about 90% and most preferably at least about 95% homologous to the sequence MTPPRLF-WVVWLLVAGTQGVNDGDMRLADGGATNQGRVEIFY-RGQWGTVCDNLWDLTDASVVCRALGFENA TQAL-GRAAFGQGSGPIMLDEVQCTGTEASLADCKSLGWL-KSNCRHERDAGVVCTNGTSTPEGLTSPCRQSSAS TSWPLPMGPGSCRATAQASLPSSSPRTPRSRCPWT-CMPMQWPQGTPCWRSSAYSSWPGTSRP (SEQ ID NO: 590) of Z22012_P42 (SEQ ID NO:255).

In some embodiments, the isolated chimeric proteins or polypeptides of the invention may comprise an amino acid sequence corresponding to or homologous to that as set forth in Z22012_P42 (SEQ ID NO:255), comprising a first amino acid sequence being at least 90% homologous to amino acids 1-125 of NP_005558 (SEQ ID NO: 551), which also corresponds to amino acids 1-125 of Z22012_P42 (SEQ ID NO:255), and a second amino acid sequence being at least 70%, optionally at least 80%, preferably at least 85%, more preferably at least 90% and most preferably at least 95% homologous to a polypeptide having the sequence GTST-PEGLTSPCRQSSASTSWPLPMGPGS-CRATAQASLPSSSPRTPRSRCPWTCMPM-QWPQGTPCWRSSAYSSWPGTSRP (SEQ ID NO: 500) corresponding to amino acids 126-205 of Z22012_P42 (SEQ ID NO:255), wherein said first amino acid sequence and second amino acid sequence are contiguous and in a sequential order.

In some embodiments, this invention provides an isolated polypeptide encoding for an edge portion of Z22012_P42 (SEQ ID NO:255), comprising an amino acid sequence being at least 70%, optionally at least about 80%, preferably at least about 85%, more preferably at least about 90% and most preferably at least about 95% homologous to the sequence GTSTPEGLTSPCRQSSASTSWPLPMGPG-SCRATAQASLPSSSPRTPRSRCPWTCMP-MQWPQGTPCWRSSAYSSWPGTSRP (SEQ ID NO: 500) of Z22012_P42 (SEQ ID NO:255).

In some embodiments, the isolated chimeric proteins or polypeptides of the invention may comprise an amino acid sequence corresponding to or homologous to that as set forth in HUMTREFAC_P9 (SEQ ID NO:245), comprising a first amino acid sequence being at least 90% homologous to amino acids 1-28 of TFF3_HUMAN (SEQ ID NO:440), which also corresponds to amino acids 1-28 of HUMTRE-FAC_P9 (SEQ ID NO:245), and a second amino acid sequence being at least 70%, optionally at least 80%, preferably at least 85%, more preferably at least 90% and most preferably at least 95% homologous to a polypeptide having the sequence QQGLWQLTGLCLGQLQTSVPCQPRTG-WTAATPMSPPRSATTGAAALTPGSLE-CLGVSSPCRKQNAPSEAPPAAPGRGMRG-SEHPCPAVIAARHCSSQLFCPFAPGKRFC (SEQ ID NO: 501) corresponding to amino acids 29-137 of HUMTRE-FAC_P9 (SEQ ID NO:245), wherein said first amino acid sequence and second amino acid sequence are contiguous and in a sequential order.

In some embodiments, this invention provides an isolated polypeptide encoding for an edge portion of HUMTRE-FAC_P9 (SEQ ID NO:245), comprising an amino acid sequence being at least 70%, optionally at least about 80%, preferably at least about 85%, more preferably at least about 90% and most preferably at least about 95% homologous to the sequence QQGLWQLTGLCLGQLQTSVPCQPRTG-WTAATPMSPPRSATTGAAALTPGSLE-CLGVSSPCRKQNAPSEAPPAA PGRGMRGSEHPCPA-VIAARHCSSQLFCPFAPGKRFC (SEQ ID NO: 501) of HUMTREFAC_P9 (SEQ ID NO:245).

In some embodiments, the isolated chimeric proteins or polypeptides of the invention may comprise an amino acid sequence corresponding to or homologous to that as set forth in HUMTREFAC_P9 (SEQ ID NO:245), comprising a first amino acid sequence being at least 70%, optionally at least 80%, preferably at least 85%, more preferably at least 90% and most preferably at least 95%, homologous to a polypeptide having the sequence MAARALCMLGLVLALLSSS-SAEEYVGLSQQGLWQLTGLCLGQLQTS-VPCQPRTGWTAATPMSPPRSATTGAAALTPGSLECL (SEQ ID NO: 591) corresponding to amino acids 29-137 of HUMTREFAC_P9 (SEQ ID NO:245), and a second amino acid sequence being at least 90% homologous to ANQCAV-PAKDRVDCGYPHVTPKE corresponding to amino acids 51-78 of Q96NX0_HUMAN (SEQ ID NO: 554), which also corresponds to amino acids 1-28 of HUMTREFAC_P9 (SEQ ID NO:245), wherein said first amino acid sequence and second amino acid sequence are contiguous and in a sequential order.

In some embodiments, this invention provides an isolated polypeptide encoding for a head of HUMTREFAC_P9 (SEQ ID NO:245), comprising a polypeptide being at least 70%, optionally at least about 80%, preferably at least about 85%, more preferably at least about 90% and most preferably at least about 95% homologous to the sequence MAARALC-MLGLVLALLSSSSAEEYVGLSQQGL-WQLTGLCLGQLQTSVPCQPRTG-WTAATPMSPPRSATTGAAALTPGSLECL (SEQ ID NO: 591) of HUMTREFAC_P9 (SEQ ID NO:245).

In some embodiments, this invention provides an isolated chimeric polypeptide encoding for an edge portion of HUMTREFAC_P9 (SEQ ID NO:245), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 137−x to 137; and ending at any of amino acid numbers 1+((n−2)−x), in which x varies from 0 to n−2.

In some embodiments, the isolated chimeric proteins or polypeptides of the invention may comprise an amino acid sequence corresponding to or homologous to that as set forth in HUMTREFAC_P9 (SEQ ID NO:245), comprising a first amino acid sequence being at least 70%, optionally at least 80%, preferably at least 85%, more preferably at least 90% and most preferably at least 95%, homologous to a polypeptide having the sequence MAARALCMLGLVLALLSSS-SAEEYVGLSQQGLWQLTGLCLGQLQTS-VPCQPRTGWTAATPMSPPRSATTGAA ALTPGSLECLGVSSPCRKQNAPSEAP-
PAAPGRGMRGSEHPCPAVIAARHC-
SSQLFCPFAPGKRFC (SEQ ID NO: 592) corresponding to amino acids 29-137 of HUMTREFAC_P9 (SEQ ID NO:245), and a second amino acid sequence being at least 90% homologous to amino acids 51-78 of NP_003217 (SEQ ID NO: 555), which also corresponds to amino acids 1-28 of HUMTREFAC_P9 (SEQ ID NO:245), wherein said, first amino acid sequence and second amino acid sequence are contiguous and in a sequential order.

In some embodiments, the term "polypeptide" is to be understood to refer to a molecule comprising from at least 2 to several thousand or more amino acids. The term "polypeptide" is to be understood to include, inter alia, native peptides (either degradation products, synthetically synthesized peptides or recombinant peptides), peptidomimetics, such as peptoids and semipeptoids or peptide analogs, which may comprise, for example, any desirable modification, including, inter alia, modifications rendering the peptides more stable while in a body or more capable of penetrating into cells, or others as will be appreciated by one skilled in the art. Such modifications include, but are not limited to N terminus modification, C terminus modification, peptide bond modification, backbone modifications, residue modification, or others. Inclusion of such peptides within the polypeptides of this invention may produce a polypeptide sharing identity with the polypeptides described herein, for example, those provided in the sequence listing.

Methods for preparing, isolating, deriving, etc., the polypeptides of this invention are well known are well known in the art. In some embodiments, the polypeptides of this invention comprise variants of known proteins. For example, and in some embodiments, the polypeptides of this invention comprise splice variants of native proteins expressed in a given subject. In some embodiments, the polypeptides may be obtained through known protein evolution techniques available in the art. In some embodiments, the polypeptides of this invention may be obtained via rational design, based on a particular native polypeptide sequence.

In some embodiments, this invention provides for antibodies or antibody fragments specifically interacting with or recognizing a polypeptide of this invention.

In one embodiment, the antibody recognizes one or more epitopes (antigen determinants) contained within the polypeptides of this invention. In some embodiments, reference to the antibody property of "specific interaction" or "recognition" is to be understood as including covalent and non-covalent associations, and with a variance of affinity over several orders of magnitude. Such terms are to be understood as relative, with respect to an index molecule, for which the antibody is though to have little to no specific interaction or recognition.

In one embodiment, the antibodies will specifically interact or recognize a particular antigen determinant. In some embodiments, the antibodies or antibody fragments of this invention will recognize or interact with a polypeptide or protein of the invention, and will not substantially recognize or interact with other molecules, even when present in the same sample, such as a biological sample. In some embodiments, the antibodies of this invention have a specificity such that the specific interaction with or binding to the antigen is at least about 2, or in some embodiments, at least about 5, or in some embodiments, at least about 10-fold greater than interaction or binding observed under the same reaction conditions with a molecule that does not include the antigenic determinant.

The antibodies may be useful, in some embodiments, in detecting qualitative and/or quantitative changes in expression of the polypeptides or polynucleotides of this invention. In some embodiments, changes in expression are associated with a particular disease or disorder, such that detection of such changes comprises a diagnostic method of this invention.

In one embodiment, this invention provides a diagnostic kit for detecting a disease, comprising reagents which detect qualitative and/or quantitative changes in expression of a polypeptide or polynucleotide of this invention.

Optionally, the kit comprises a NAT-based technology; optionally and preferably, the kit further comprises at least one nucleotide probe or primer, alternatively and optionally this kit comprises at least one primer pair capable of selectively hybridizing to a nucleic acid sequence as described herein; alternatively and optionally, said kit further comprises at least one oligonucleotide capable of selectively hybridizing to a nucleic acid sequence according to any of the above claims.

Alternatively and optionally, the kit comprises an antibody according to any of the above claims (optionally and preferably, the kit further comprises at least one reagent for performing an ELISA or a Western blot.

In some embodiments, this invention provides a diagnostic method, for example, a method of detection of a polypeptide or polynucleotide of this invention, whereby expression, or relative changes in expression of the polypeptide or polynucleotide herald the onset, severity, or prognosis of an individual with regard to a particular disease, disorder or condition.

In some embodiments, such detection may comprise detection of specific expression of a splice variant, or other polypeptide or polynucleotide of this invention, via any means known in the art, and as described herein. In some embodiments, detection of the following genes and/or their products is part of the diagnostic methods of this invention: HSFLT, HSI1RA, HSPLGF, HUMSP18A, F05068, HUMIL10, or any combination thereof. In some embodiments, detection of these genes, or relative changes in expression of the genes, their products or certain variants thereof herald the onset, severity or prognosis of cardiovascular disease in a subject. In some embodiments, the polypeptides, polynucleotides and/or methods of this invention may be useful in the treatment, diagnosis or prognosis assessment of any cardiovascular disease, including, inter alia, myocardial infarct, acute coronary syndrome, coronary artery disease, angina pectoris (stable and unstable), cardiomyopathy, myocarditis, congestive heart failure or any type of heart failure, reinfarction, assessment of thrombolytic therapy, assessment of myocardial infarct size, differential diagnosis between heart-related versus lung-related conditions (such as pulmonary embolism), the differential diagnosis of Dyspnea, cardiac valves related conditions, vascular disease, or any combination thereof.

The polypeptides and/or polynucleotides of this invention may serve as markers or indicators of disease initation, severity and/or response to treatment, for the indicated disease, disorder or condition, and their use as such is to be considered part of this invention, and part of the methods of this invention.

In some embodiments, detection of SFLT, HSI1RA, HSPLGF, HUMSP18A, F05068, HUMIL10, or any combination thereof, or relative changes in expression of the genes, their products or certain variants thereof herald the onset, severity or prognosis of cerebrovascular disease in a subject. In some embodiments, the polypeptides, polynucleotides and/or methods of this invention may be useful in the treatment, diagnosis or prognosis assessment of any cerebrovascular disease, including, inter alia, stroke, including any type of stroke or neural tissue injury, or any type of cerebrovascular accident, ischemic stroke, hemorrhagic stroke or transient ischemic attacks, thrombotic, embolic, lacunar or hypoperfusion types of strokes, brain trauma, etc. In some embodiments, the polypeptides, polynucleotides and/or methods of this invention may be useful in the establishment of the timing of stroke; the type of stroke; the extent of tissue damage as a result of the stroke; response to immediate treatments that are meant to alleviate the extent of stroke and brain damage, when available, or any combination thereof.

In some embodiments, the polypeptides, polynucleotides and/or methods of this invention may be useful in the diagnosis of stroke and indication if an ischemic stroke has occurred; or a hemorrhagic stroke has occurred; or prognosis of a subsequent cerebral vasospasm; etc.

In some embodiments, the polypeptides, polynucleotides and/or methods of this invention may be useful in identifying a patient at risk for cerebral vasospasm. Such methods preferably comprise comparing an amount of one or more marker(s) predictive of a subsequent cerebral vasospasm in a test sample from a patient diagnosed with a subarachnoid hemorrhage. Such markers may be one or more markers related to blood pressure regulation, markers related to inflammation, markers related to apoptosis, and/or specific markers of neural tissue injury.

In some embodiments, the polypeptides, polynucleotides and/or methods of this invention may be useful in the diagnosis, treatment or assessment of the prognosis of a subject with cardiomyopathy and/or myocarditis, and/or related conditions as described herein. In some embodiments, markers utilized in this context are polynucleotides encoding or polypeptides comprising HSFLT, HSI1Ra, HSPLGF, HUMSP18A, F05068 and/or HUMIL10 clusters, or variants thereof, or combinations thereof.

In some embodiments, the polypeptides, polynucleotides and/or methods of this invention may be useful in the diagnosis, treatment or assessment of the prognosis of a subject with acute and chronic inflammation, and/or CVS diseases, and in some embodiments, the marker comprises one or more of HSFLT variants, HSI1Ra variants, HSPLGF variants, HUMSP18A variants, F05068 variants and/or HUMIL10 variants, including for a spectrum of diseases where an inflammatory process plays a substantial role. In some embodiments, the polypeptides, polynucleotides and/or methods of this invention may be useful in the diagnosis, treatment or assessment of the prognosis of a subject with hypercholesterolemia, diabetes, atherosclerosis, inflammation that involves blood vessels—whether acute or chronic including but not limited to the coronary arteries and blood vessels of the brain, myocardial infarction, cerebral stroke, peripheral vascular disease, vasculitis, polyarteritis nodosa, ANCA associated small vessel vasculitis, Churg-Strauss syndrome, Henoch-Schonlein purpura, scleroderma, thromboangiitis obliterans, temporal arteritis, Takayasu's arteritis, hypersensitivity vasculitis, Kawasaki disease, Behçet syndrome, and their complications including but not limited to coronary disease, angina pectoris, deep vein thrombosis, renal disease, diabetic nephropathy, lupus nephritis, renal artery thrombosis, renal artery stenosis, atheroembolic disease of the renal arteries, renal vein thrombosis, hemolytic uremic syndrome, thrombotic thrombocytopenic purpura, arteriolar nephrosclerosis, preeclampsia, eclampsia, albuminuria, microalbuminuria, glomerulonephritis, renal failure, hypertension, uremia, cerebrovascular disease, peripheral vascular disease, intermittent claudication, abdominal angina; rheumatic/autoimmune diseases that involve systemic immune reaction including but not limited to rheumatoid arthritis, scleroderma, mixed connective tissue disease, Sjogren syndrome, ankylosing spondylitis, spondyloarthropathy, psoriasis, psoriatic arthritis, myositis and systemic lupus erythematosus; acute and/or chronic infective processes that involve systemic immune reaction including but not limited to pneumonia, bacteremia, sepsis, pyelonephritis, cellulitis, osteomyelitis, meningitis and viral hepatitis; malignant and idiopathic processes that involve systemic immune reaction and/or proliferation of immune cells including but not limited to granulomatous disorders, Wegener's granulomatosis, lymphomatoid granulomatosis/polymorphic reticulosis, idiopathic midline granuloma, multiple myeloma, Waldenstrom's macroglobulinemia, Castleman's disease, amyloidosis, lymphoma, histiocytosis, renal cell carcinoma and paraneoplastic syndromes; conditions where CRP was shown to have a positive correlation with the presence of the condition including but not limited to weight loss, anorexia-cachexia syndrome, extent of disease, recurrence in advanced cancer, diabetes (types 1 & 2), obesity, hypertension, preterm delivery; conditions which have similar symptoms, signs and complications as the conditions above and where the differential diagnosis between them and the conditions above is of clinical importance including but not limited to: other (non vascular) causes of heart disease, renal disease and cerebral disease; other (non rheumatic) causes of arthropathy and musculoskeletal pain; other causes of non-specific symptoms and signs such as fever of unknown origin, loss of appetite, weight loss, nonspecific pains, breathing difficulties, anxiety, or any combination thereof, or any disease disorder or condition associated with inflammation.

In some embodiments, the polypeptides, polynucleotides and/or methods of this invention may be useful in the diagnosis, treatment or assessment of the prognosis of a subject with congestive heart failure (CHF), and in some embodiments, the marker comprises a marker optionally selected from the group consisting of one or more variants in HSFLT variants, HSI1Ra variants, HSPLGF variants, HUMSP18A variants, F05068 variants and/or HUMIL10 variants or combinations thereof. In some embodiments, the polypeptides, polynucleotides and/or methods of this invention may be useful in the diagnosis, treatment or assessment of the prognosis of a subject with sudden cardiac death, from arrhythmia or any other heart related reason; rejection of a transplanted heart; conditions that lead to heart failure including but not limited to myocardial infarction, angina, arrhythmias, valvular diseases, atrial and/or ventricular septal defects; conditions that cause atrial and or ventricular wall volume overload, including but not limited to systemic arterial hypertension, pulmonary hypertension and pulmonary embolism; conditions which have similar clinical symptoms as heart failure and as states that cause atrial and or ventricular pressure-overload, where the differential diagnosis between these conditions to the latter is of clinical importance including but not limited to breathing difficulty and/or hypoxia due to pulmonary disease, anemia or anxiety.

Each polypeptide or polynucleotide of the present invention described herein may be used as a potential marker for cardiovascular conditions, might optionally be used alone or in combination with one or more other variant markers described herein, and or in combination with known markers for cardiovascular conditions, including but not limited to Heart-type fatty acid binding protein (H-FABP), Angiotensin, C-reactive protein (CRP), myeloperoxidase (MPO), and/or in combination with the known protein(s) for the variant marker as described herein. Each variant marker of the present invention described herein as potential marker for cerebrovascular conditions, might optionally be used alone or in combination with one or more other variant markers described herein, and or in combination with known markers for cerebrovascular conditions, including but not limited to CRP, S100b, BNGF, CD40, MCP1, N-Acetyl-Aspartate (NAA), N-methyl-d-aspartate (NMDA) receptor antibodies (NR2Ab), and/or in combination with the known protein(s) for the variant marker as described herein.

In some embodiments, the phrase "marker-detectable disease is a particular cluster marker detectable disease" refers to the fact that the any polynucleotides and/or polypeptides of this invention can be used to detect the indicated disease, or assess the parameters of the disease, etc., as described herein. In some embodiments, a particular cluster will be useful for the diagnosis, assessment and prognostic indications regarding the indicated disease disorder or condition.

In one embodiment, the marker-detectable disease is a cluster HSFLT marker-detectable disease and is a cancer, including but not limited to colon cancer, breast cancer, ovarian cancer, prostate cancer, or lung cancer.

In one embodiment, the marker-detectable disease is a cluster Z25299 marker-detectable disease and is a cancer including but not limited to colon cancer, breast cancer, ovarian cancer, lung cancer; and colon, breast, ovarian, and lung cancer invasion and metastasis.

In one embodiment, the marker-detectable disease is a cluster AA336074 marker-detectable disease and is a cancer, including but not limited to breast cancer, lung cancer; and breast and lung cancer invasion and metastasis.

In one embodiment, the marker-detectable disease is a cluster HSPLGF marker-detectable disease and is a variety of cancers, including but not limited to colon cancer, lung cancer; and colon and lung cancer invasion and metastasis.

In one embodiment, the marker-detectable disease is a cluster HSI1RA, cluster HUMSP18A, cluster F05068 marker-detectable disease and is a variety of cancers, including but not limited to lung cancer and lung cancer invasion and metastasis.

In one embodiment, the marker-detectable disease is a cluster Z22012, cluster HUMTREFAC, or cluster Z39737 marker-detectable disease and is a prostate cancer.

With regard to lung cancer, the disease (and/or diagnostic method to be performed) comprises, in some embodiments, one or more of invasive or metastatic lung cancer; squamous cell lung carcinoma, lung adenocarcinoma, carcinoid, small cell lung cancer or non-small cell lung cancer; detection of overexpression in lung metastasis (vs. primary tumor); detection of overexpression in lung cancer, for example non small cell lung cancer, for example adenocarcinoma, squamous cell cancer or carcinoid, or large cell carcinoma; identification of a metastasis of unknown origin which originated from a primary lung cancer; assessment of a malignant tissue residing in the lung that is from a non-lung origin, including but not limited to: osteogenic and soft tissue sarcomas; colorectal, uterine, cervix and corpus tumors; head and neck, breast, testis and salivary gland cancers; melanoma; and bladder and kidney tumors; distinguishing between different types of lung cancer, therefore potentially affect treatment choice (e.g. small cell vs. non small cell tumors); analysis of unexplained dyspnea and/or chronic cough and/or hemoptysis; differential diagnosis of the origin of a pleural effusion; diagnosis of conditions which have similar symptoms, signs and complications as lung cancer and where the differential diagnosis between them and lung cancer is of clinical importance including but not limited to: non-malignant causes of lung symptoms and signs, including but not limited to: lung lesions and infiltrates, wheeze, stridor, tracheal obstruction, esophageal compression, dysphagia, recurrent laryngeal nerve paralysis, hoarseness, phrenic nerve paralysis with elevation of the hemidiaphragm and Horner syndrome; or detecting a cause of any condition suggestive of a malignant tumor including but not limited to anorexia, cachexia, weight loss, fever, hypercalcemia, hypophosphatemia, hyponatremia, syndrome of inappropriate secretion of antidiuretic hormone, elevated ANP, elevated ACTH, hypokalemia, clubbing, neurologic-myopathic syndromes and thrombophlebitis.

In some embodiments, the polypeptides and/or polynucleotides of this invention may be useful as potential markers for lung cancer, alone or in combination with one or more alternative polynucleotides or polypeptides described herein, and/or in combination with known markers for lung cancer, including but not limited to CEA, CA15-3, Beta-2-microglobulin, CA19-9, TPA, and/or in combination with the known protein(s) for the variant marker as described herein.

With regard to breast cancer, the disease (and/or diagnostic method to be performed) the polypeptides, polynucleotides may be useful in determining a probable outcome in breast cancer; detecting breast cancer in patients with age above 55 and/or patients with an age below 45; identification of a metastasis of unknown origin which originated from a primary breast cancer tumor; assessing lymphadenopathy, and in particular axillary lymphadenopathy; distinguishing between different types of breast cancer, therefore potentially affect treatment choice (e.g. as HER-2); differentially diagnosing between a benign and malignant breast mass; as a tool in the assessment of conditions affecting breast skin (e.g. Paget's disease) and their differentiation from breast cancer; differential diagnosis of breast pain or discomfort resulting from either breast cancer or other possible conditions (e.g. mastitis, Mondors syndrome); non-breast cancer conditions which have similar symptoms, signs and complications as breast cancer and where the differential diagnosis between them and breast cancer is of clinical importance including but not limited to: abnormal mammogram and/or nipple retraction and/or nipple discharge due to causes other than breast cancer, including but not limited to benign breast masses, melanoma, trauma and technical and/or anatomical variations; determining a cause of any condition suggestive of a malignant tumor including but not limited to anorexia, cachexia, weight loss, fever, hypercalcemia, paraneoplastic syndrome; or determining a cause of lymphadenopathy, weight loss and other signs and symptoms associated with breast cancer but originate from diseases different from breast cancer including but not limited to other malignancies, infections and autoimmune diseases.

Each variant marker of the present invention described herein as potential marker for breast cancer, might optionally be used alone or in combination with one or more other variant breast cancer described herein, and/or in combination with known markers for breast cancer, including but not limited to Calcitonin, CA15-3 (Mucin1), CA27-29, TPA, a combination of CA 15-3 and CEA, CA 27.29 (monoclonal antibody directed against MUC1), Estrogen 2 (beta), HER-2 (c-erbB2), and/or in combination with the known protein(s) for the variant marker as described herein.

With regard to prostate cancer, the disease (and/or diagnostic method to be performed) optionally and preferably comprises one or more of invasive or metastatic prostate cancer.

Each marker of the present invention described herein as potential marker for prostate cancer, might optionally be used alone or in combination with one or more other variant prostate cancer described herein, and/or in combination with known markers for prostate cancer, including but not limited to PSA, PAP (prostatic acid phosphatase), CPK-BB, PSMA, PCA3, DD3, and/or in combination with the known protein(s) for the variant marker as described herein.

It is to be understood that any polynucleotide or polypeptide of this invention may be useful as a marker for a disease, disorder or condition, and such use is to be considered a part of this invention.

With regard to colon cancer, the disease (and/or diagnostic method to be performed) optionally and preferably comprises one or more of invasive or metastatic colon cancer.

Each marker of the present invention described herein as potential marker for colorectal cancer, might optionally be used alone or in combination with one or more other variant colorectal cancer described herein, and/or in combination with known markers for colorectal cancer, including but not limited to CEA, CA19-9, CA50, and/or in combination with the known protein(s) for the variant marker as described herein.

With regard to ovarian cancer, the polypeptides and/or polynucleotide may be used in the diagnosis, treatment or prognostic assessment of invasive or metastatic ovarian cancer; correlating stage and malignant potential; identification of a metastasis of unknown origin which originated from a primary ovarian cancer, for example gastric carcinoma (such as Krukenberg tumor), breast cancer, colorectal carcinoma and pancreatic carcinoma; distinguishing between different types of ovarian cancer, therefore potentially affect treatment choice (e.g. discrimination between epithelial tumors and germ cell tumors); differential diagnosis between benign and malignant ovarian cysts; diagnosing a cause of infertility, for example differential diagnosis of various causes thereof; detecting of one or more non-ovarian cancer conditions that may elevate serum levels of ovary related markers, including but not limited to: cancers of the endometrium, cervix, fallopian tubes, pancreas, breast, lung and colon; nonmalignant conditions such as pregnancy, endometriosis, pelvic inflammatory disease and uterine fibroids; diagnosing conditions which have similar symptoms, signs and complications as ovarian cancer and where the differential diagnosis between them and ovarian cancer is of clinical importance including but not limited to: non-malignant causes of pelvic mass, including, but not limited to: benign (functional) ovarian cyst, uterine fibroids, endometriosis, benign ovarian neoplasms and inflammatory bowel lesions; determining a cause of any condition suggestive of a malignant tumor including but not limited to anorexia, cachexia, weight loss, fever, hypercalcemia, skeletal or abdominal pain, paraneoplastic syndrome, or ascites.

In some embodiments, the polypeptides and/or polynucleotides of this invention may be used in the diagnosis, treatment or prognostic assessment of ovarian cancer, alone or in combination with one or more polypeptides and/or polynucleotides of this invention, and/or in combination with known markers for ovarian cancer, including but not limited to CEA, CA125 (Mucin 16), CA72-4TAG, CA-50, CA 54-61, CA-195 and CA 19-9 in combination with CA-125, and/or in combination with the known protein(s) associated with the indicated polypeptide or polynucleotide, as described herein.

Detecting specific expression may in some embodiments be performed with a NAT-based technology (optionally comprising at least one nucleotide probe or primer), and/or with an immunoassay (optionally comprising an antibody according to any of the embodiments described herein).

In some embodiments, this invention provides a method of detecting, treating and/or assessing prognosis of a disease, disorder or condition, comprising detecting polypeptides and/or polynucleotides of this invention. In some embodiments, such methods are also referred to herein as methods of screening for variant-detectable disease, whereby the detection of variant expression serves as an indicator for the disease. In some embodiments, such detection may make use of a biomarker, antibody or any method or assay as described herein.

In some embodiments, this invention provides a method for screening for a disease, comprising detecting expression of:
  a. a polypeptide having an amino acid sequence as set forth in SEQ ID NOs: 16-31, 65-70, 99-102, 127-138, 215-219, 236, 245, 254-255, 307-308 or a homologue or fragment thereof
  b. a polypeptide comprising a bridge, edge portion, tail, or head portion, wherein said polypeptide has an amino acid sequence as set forth in SEQ ID NOs:459-501, 576-592 or a homologue or fragment thereof
  c. a polynucleotide having a nucleic acid sequence as set forth in SEQ ID NOs: 1-15, 61-64, 96-98, 114-126, 189-195, 211-214, 235, 244, 152-253, 305-306, 340-344. or a homologue or fragment thereof
  d. a polynucleotide comprising a node having a nucleic acid sequence as set forth in SEQ ID NOs: 32-60, 71-95, 103-113, 139-188, 196-219, 220-234, 237-243, 246-251, 256-304, 309-339, 350-358, 502-530;
  e. an antibody capable of specifically binding to at least one epitope of a polypeptide comprising an amino acid sequence as set forth in SEQ ID NOs: 16-31, 65-70, 99-102, 127-138, 215-219, 236, 245, 254-255, 307-308, 459-501, 576-592;
  f. an oligonucleotide having a nucleic acid sequence as set forth in SEQ ID NOs:363, 383, 386, 389, 393, 396, 399, 407, 410, 414, 417, 420, 424, 427, 431, 434, 437, 444, 447, 452, 455, 458;
  g. a primer pair, comprising a pair of isolated oligonucleotides capable of specifically hybridizing to at least a portion of a polynucleotide having a nucleic acid sequence as set forth in SEQ ID NOs: 363, 383, 386, 389, 393, 396, 399, 407, 410, 414, 417, 420, 424, 427, 431, 434, 437, 444, 447, 452, 455; or homologous thereto;
  h. a primer pair, comprising a pair of isolated oligonucleotides capable of specifically hybridizing to at least a portion of a polynucleotide having a nucleic acid sequence as set forth in SEQ ID NOs:361-362; 384-385; 387-388; 390-391; 394-395; 397-398; 400-401; 408-409; 411-412; 415-416; 418-419; 421-422; 425-426; 428-429; 432-433; 435-436; 438-439; 445-446; 448-449; 453-454; 456-457, whereby qualitative or quantitative differences in expression as compared to an index sample is indicator for the treatment, diagnosis or assessment of prognosis of the disease, disorder or condition.

In some embodiments, a method of this invention may make use of a polynucleotide, polypeptide, vector, antibody, biomarker, or combination thereof, as described herein, including any embodiments thereof.

In some embodiments, the methods of this invention may be conducted on a cell or tissue or body fluid sample isolated from a subject having, predisposed to, or suspected of having the disease disorder or condition. In some embodiments, the methods are directed to the monitoring of disease progression and/or treatment efficacy and/or relapse of the indicated disease, disorder or condition.

In another embodiment, this invention provides methods for the selection of a particular therapy, or optimization of a given therapy for a disease, disorder or condition, the method comprising quantitatively and/or qualitatively determining or assessing expression of the polypeptides and/or polynucleotides, whereby differences in expression from an index sample, or a sample taken from a subject prior to the initiation of the therapy, or during the course of therapy, is indicative of the efficacy, or optimal activity of the therapy.

In some embodiments, for the polypeptides and/or polynucleotides of this invention are useful in applications in cardiac disease, as described, and provide for sensitive and accurate assessment. Biomolecular sequences (amino acid and/or nucleic acid sequences) uncovered using the methodology of the present invention and described herein can be utilized, in some embodiments, as tissue or pathological markers and/or as drugs or drug targets for treating, preventing, diagnosing or assessing a disease.

In some embodiments, these markers are specifically released to the bloodstream under conditions of cardiac disease and/or cardiac pathology, as described herein. presenting some embodiments, this invention identified, or provides the means to identify clusters (genes) which are characterized in that their transcripts are differentially expressed in heart muscle tissue compared with other normal tissues, for example, in comparison to skeletal muscle tissue. In acute conditions under which heart muscle tissue experiences hypoxia (with or without necrosis), intracellular proteins that are not normally secreted can leak through the cell membrane to the extracellular space. Therefore, heart muscle tissue differentially expresses proteins, and analysis methods as described herein may herald acute heart damage, thereby serving as cardiac disease markers.

In some embodiments, the identification/detection of the polypeptides and/or polynucleotides of this invention signify leakage of intracellular content, which can occur in chronic damage to the heart muscle, therefore proteins selected according to this method are potential markers for chronic heart conditions. When a protein that is differentially expressed in heart muscle is secreted, it may prove useful as a chronic heart damage marker, since secretion implies that the protein has a physiological role exterior to the cell, and in some embodiments may be used by the heart muscle to respond to the chronic damage.

In some embodiments, the markers described herein are overexpressed in heart versus skeletal muscle.

In some embodiments this invention provides diagnostic assays for cardiac disease and/or cardiac pathology, including but not limited to cardiac damage, and methods of use of such markers for detection of cardiac disease and/or cardiac pathology, including but not limited to cardiac damage (alone or in combination), involving detection, in some embodiments of expression in a sample taken from a subject (patient), which in some embodiments, is a blood sample.

In some embodiments, the polypeptides and polynucleotides and methods of this invention find application in various cardiovascular and cerebrovascular conditions, and in some embodiments, the conditions may also optionally include stroke and various cardiomyopathies.

In some embodiments, the marker-detectable disease involves cluster Z25299 and comprises a variety of cancers, including but not limited to colon cancer, breast cancer, ovarian cancer, lung cancer; and colon, breast, ovarian, and lung cancer invasion and metastasis.

In some embodiments, the marker-detectable disease involves cluster AA336074 and comprises a variety of cancers, including but not limited to breast cancer, lung cancer; and breast and lung cancer invasion and metastasis.

In some embodiments, the marker-detectable disease involves cluster HSPLGF and comprises a variety of cancers, including but not limited to colon cancer, lung cancer; and colon and lung cancer invasion and metastasis.

In some embodiments, the marker-detectable disease involves cluster HSI1RA, cluster HUMSP18A, cluster F05068 and comprises a variety of cancers, including but not limited to lung cancer and lung cancer invasion and metastasis.

In some embodiments, the marker-detectable disease involves cluster Z22012, cluster HUMTREFAC, or cluster Z39737 and comprises prostate cancer.

According to some embodiments of the present invention, any of the above nucleic acid and/or amino acid sequences further comprises any sequence having at least about 70%, at least about 80%, at least about 90%, least about 95% homology to the polynucleotides herein described.

The nucleic acid sequences and/or amino acid sequences shown herein as embodiments of the present invention relate, in some embodiments, to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that the terms "oligonucleotide" and "polynucleotide", or "peptide" and "polypeptide", may optionally be used interchangeably.

All technical and scientific terms used herein should be understood to have the meaning commonly understood by a person skilled in the art to which this invention belongs, as well as any other specified description. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein.

BRIEF DESCRIPTION OF THE DRAWINGS

The invention is herein described, by way of example only, with reference to the accompanying drawings. With specific reference now to the drawings in detail, it is stressed that the particulars shown are by way of example and for purposes of illustrative discussion of the embodiments of the present invention only, and are presented in the cause of providing what is believed to be the most useful and readily understood description of the principles and conceptual aspects of the invention. In this regard, no attempt is made to show structural details of the invention in more detail than is necessary for a fundamental understanding of the invention, the description taken with the drawings making apparent to those skilled in the art how the several forms of the invention may be embodied in practice.

In the drawings.

DESCRIPTION OF EMBODIMENTS

Figure 1:
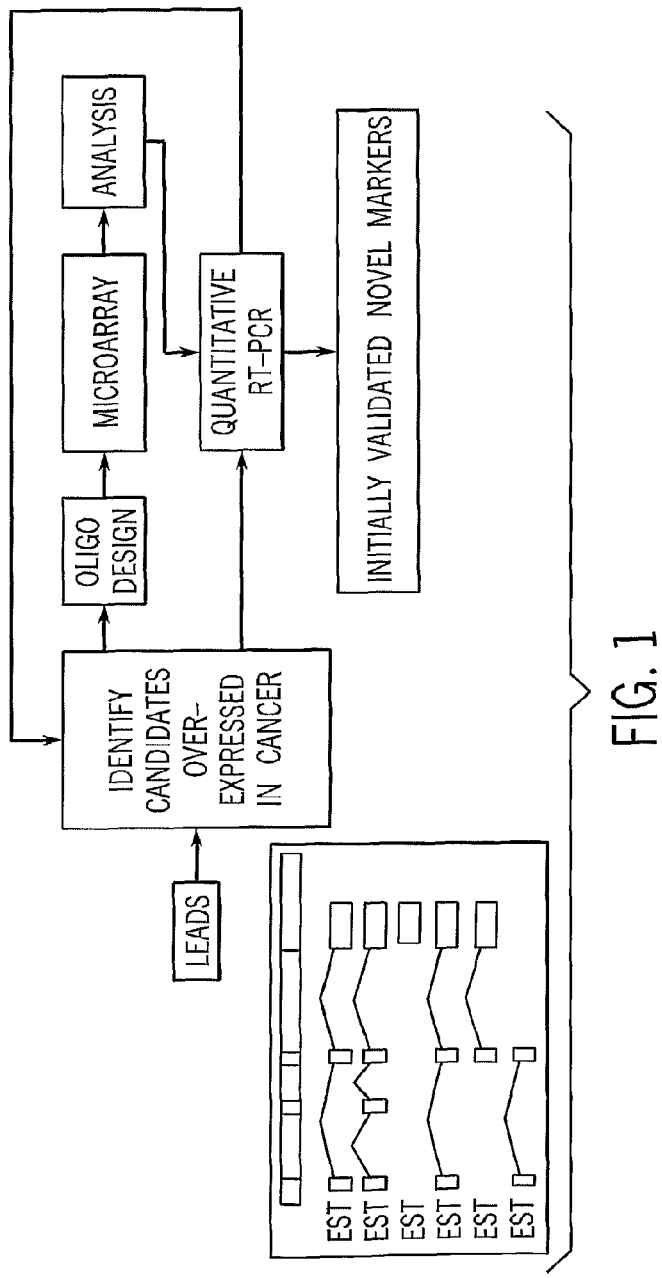
FIG. 1: Schematic description of the cancer biomarker selection engine.

The present invention provides, in some embodiments, polynucleotides and polypeptides and uses thereof, as further described herein. polynucleotides and polypeptides described herein, in some embodiments, represent variants, which may optionally be used as diagnostic markers.

In some embodiments, these variants are useful as diagnostic markers for certain diseases, and as such the term "marker-detectable" or "variant-detectable" with regard to diseases is to be understood as encompassing use of the described polynucleotides and/or polypeptides.

In some embodiments, certain diseases are associated with differential expression, qualitatively or quantitatively, of the polynucleotides and polypeptides of this invention. Assessment of such expression, in turn, may in some embodiments, serve as a marker for a particular disease state, susceptibility, pathogenesis, etc., including any desired disease-specific event, whose analysis is useful, as will be appreciated by one skilled in the art. In one embodiment, such use as a marker is also referred to herein as the polynucleotides and polypeptides being "variant disease markers".

The polynucleotides and polypeptides of the present invention, alone or in combination, in some embodiments, can be used for, and in some embodiments are a part of the methods of prognosis, prediction, screening, early diagnosis, staging, therapy selection and treatment monitoring of a marker-detectable disease. For example, in some embodiments, these markers may be used for the staging of disease in a patient (for example if the disease features cancer) and/or monitoring the progression of the disease. Furthermore, the markers of the present invention, alone or in combination, can be used for detection of the source of metastasis found in anatomical places other than the originating tissue, again in the example of cancer. Also, one or more of the markers may optionally be used in combination with one or more other disease markers (other than those described herein).

Biomolecular sequences (amino acid and/or nucleic acid sequences) uncovered using the methodology of the present invention and described herein can be efficiently utilized, in some embodiments, as tissue or pathological markers and/or as drugs or drug targets for treating or preventing a disease.

In some embodiments, these markers are released to the bloodstream under conditions of a particular disease, and/or are otherwise expressed at a much higher level and/or specifically expressed in tissue or cells afflicted with or demonstrating the disease. In some embodiments, the measurement of these markers, alone or in combination, in patient samples provides information that the diagnostician can correlate with a probable diagnosis of a particular disease and/or a condition that is indicative of a higher risk for a particular disease.

The present invention provides, in some embodiments, diagnostic assays for a marker-detectable disease and/or an indicative condition, and methods of use of such markers for detection of marker-detectable disease and/or an indicative condition, for example in a sample taken from a subject (patient), which in some embodiments, is a blood sample.

Some embodiments of this invention have been exemplified herein wherein cellular localization was determined via the use of four different software programs: (i) tmhmm (from Center for Biological Sequence Analysis, Technical University of Denmark DTU or (ii) tmpred (from EMBnet, maintained by the ISREC Bionformatics group and the LICR Information Technology Office, Ludwig Institute for Cancer Research, Swiss Institute of Bioinformatics for transmembrane region prediction; (iii) signalp_hmm or (iv) signalp_nn (both from Center for Biological Sequence Analysis, Technical University of Denmark DTU for signal peptide prediction. The terms "signalp_hmm" and "signalp_nn" refer to two modes of operation for the program SignalP_hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004; 28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T->C", for example, means that the SNP results in a change at the position given in the table from T to C. Similarly, "M->Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Some embodiments of this invention have been exemplified herein wherein homology to known proteins was determined by Smith-Waterman version 5.1.2 using special (non default) parameters as follows:
model=sw.model
GAPEXT=0
GAPOP=100.0
MATRIX=blosum100

Some embodiments of this invention have been exemplified herein wherein overexpression of a cluster in cancer was a determination based on ESTs. A key to the p values with regard to the analysis of such overexpression is as follows:
library-based statistics: P-value without including the level of expression in cell-lines (P1)
library based statistics: P-value including the level of expression in cell-lines (P2)
EST clone statistics: P-value without including the level of expression in cell-lines (SP1)
EST clone statistics: predicted overexpression ratio without including the level of expression in cell-lines (R3)
EST clone statistics: P-value including the level of expression in cell-lines (SP2)
EST clone statistics: predicted overexpression ratio including the level of expression in cell-lines (R4)

Library-based statistics refer to statistics over an entire library, while EST clone statistics refer to expression only for ESTs from a particular tissue or cancer.

Some embodiments of this invention have been exemplified herein wherein overexpression of a cluster in cancer was a determination based on microarray use. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA. The probe names follow the Affymetrix naming convention. The data is available from NCBI Gene Expression Omnibus (see Edgar et al, Nucleic Acids Research, 2002, Vol. 30, No. 1 207-210). The dataset (including results) is available for the Series GSE1133 database (published on March 2004); a reference to these results is as follows: Su et al (Proc Natl Acad Sci USA. 2004 Apr. 20; 101(16):6062-7. Epub 2004 Apr. 9).

Oligonucleotide microarray results taken from Affymetrix data were from chips available from Affymetrix Inc, Santa Clara, Calif., USA. The probe names follow the Affymetrix naming convention. The data is available from NCBI Gene Expression Omnibus (see Edgar et al, Nucleic Acids Research, 2002, Vol. 30, No. 1 207-210). The dataset (including results) is available for the Series GSE1133 database (published on March 2004); a reference to these results is as follows: Su et al (Proc Natl Acad Sci USA. 2004 Apr. 20; 101(16):6062-7. Epub 2004 Apr. 9).

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below (the first word is the abbreviation while the second word is the full name):
("BONE", "bone");
("COL", "colon");
("EPI", "epithelial");
("GEN", "general");
("LIVER", "liver");
("LUN", "lung");
("LYMPH", "lymph nodes");
("MARROW", "bone marrow");
("OVA", "ovary");
("PANCREAS", "pancreas");
("PRO", "prostate");
("STOMACH", "stomach");
("TCELL", "T cells");
("THYROID", "Thyroid");
("MAM", "breast");
("BRAIN", "brain");
("UTERUS", "uterus");
("SKIN", "skin");
("KIDNEY", "kidney");
("MUSCLE", "muscle");
("ADREN", "adrenal");
("HEAD", "head and neck");
("BLADDER", "bladder");

It should be noted that the terms "segment", "seg" and "node" (abbreviated as "N" in the names of nodes) are used interchangeably in reference to nucleic acid sequences of the present invention, they refer to portions of nucleic acid sequences that were shown to have one or more properties as described herein. They are also the building blocks that were used to construct complete nucleic acid sequences as described in greater detail elsewhere herein. Optionally and preferably, they are examples of oligonucleotides which are embodiments of the present invention, for example as amplicons, hybridization units and/or from which primers and/or complementary oligonucleotides may optionally be derived, and/or for any other use.

In some embodiments, the phrase "disease" refers to its commonly understood meaning, and includes, inter alia, any type of pathology and/or damage, including both chronic and acute damage, as well as a progress from acute to chronic damage.

In some embodiments, the phrase "marker" in the context of the present invention refers to a nucleic acid fragment, a peptide, or a polypeptide, which is differentially present in a sample taken from patients (subjects) having one of the herein-described diseases or conditions, as compared to a comparable sample taken from subjects who do not have one the above-described diseases or conditions.

In some embodiments, the phrase "differentially present" refers to differences in the quantity or quality of a marker present in a sample taken from patients having one of the herein-described diseases or conditions as compared to a comparable sample taken from patients who do not have one of the herein-described diseases or conditions. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present. Optionally, a relatively low amount of up-regulation may serve as the marker, as described herein. One of ordinary skill in the art could easily determine such relative levels of the markers; further guidance is provided in the description of each individual marker below.

In some embodiments, the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

In some embodiments, the phrase "qualitative" when in reference to differences in expression levels of a polynucleotide, polypeptide or cluster as described herein, refers to the presence versus absence of expression, or in some embodiments, the temporal regulation of expression, or in some embodiments, the timing of expression, or in some embodiments, the variant expressed, or in some embodiments, any post-translational modifications to the expressed molecule, and others, as will be appreciated by one skilled in the art. In some embodiments, the phrase "qualntitative" when in reference to differences in expression levels of a polynucleotide, polypeptide or cluster as described herein, refers to absolute differences in quantity of expression, as determined by any means, known in the art, or in other embodiments, relative differences, which may be statistically significant, or in some embodiments, when viewed as a whole or over a prolonged period of time, etc., indicate a trend in terms of differences in expression.

In some embodiments, the term "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can, in some embodiments, be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

In some embodiments, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

In some embodiments, the term "test amount" of a marker refers to an amount of a marker in a subject's sample that is consistent with a diagnosis of a particular disease or condition. A test amount can be either in absolute amount (e.g., microgram/ml) or a relative amount (e.g., relative intensity of signals).

In some embodiments, the term "control amount" of a marker can be any amount or a range of amounts to be compared against a test amount of a marker. For example, a control amount of a marker can be the amount of a marker in a patient with a particular disease or condition or a person without such a disease or condition. A control amount can be either in absolute amount (e.g., microgram/ml) or a relative amount (e.g., relative intensity of signals).

In some embodiments, the term "detect" refers to identifying the presence, absence or amount of the object to be detected.

In some embodiments, the term "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," or "specifically interacts or binds" when referring to a protein or peptide (or other epitope), refers, in some embodiments, to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

In another embodiment, the present invention relates to bridges, tails, heads and/or insertions, and/or analogs, homologs and derivatives of such peptides. Such bridges, tails, heads and/or insertions are described in greater detail below with regard to the Examples.

In some embodiments, the term "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

In some embodiments, the term "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

In some embodiments, the term "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

In some embodiments, a bridge between a tail or a head or a unique insertion, and a "known protein" portion of a variant, comprises at least about 10 amino acids, or in some embodiments at least about 20 amino acids, or in some embodiments at least about 30 amino acids, or in some embodiments at least about 40 amino acids, in which at least one amino acid is from the tail/head/insertion and at least one amino acid is from the "known protein" portion of a variant. In some embodiments, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49−x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49−x (for example) is not less than 1, nor 50+((n−2)−x) (for example) greater than the total sequence length.

In another embodiment, this invention provides isolated nucleic acid molecules, which in some embodiments encode for splice variants, having a nucleotide sequence as set forth in any one of the sequences listed herein, being homologous to such sequences, at a percent as described herein, or a sequence complementary thereto. In another embodiment, this invention provides an oligonucleotide of at least about 12 nucleotides, which specifically hybridizes with the nucleic acid molecules of this invention. In another embodiment, this invention provides vectors, cells, liposomes and compositions comprising the isolated nucleic acids or polypeptides of this invention, as appropriate.

In another embodiment, this invention provides a method for detecting the polypeptides of this invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a polynucleotide of this invention in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a the polynucleotide in the biological sample.

In some embodiments of the present invention, the polypeptides/polynucleotides described herein are non-limiting examples of markers for diagnosing marker-detectable disease and/or an indicative condition. Each polypeptide/polynucleotide marker of the present invention can be used alone or in combination, for various uses, including but not limited to, prognosis, prediction, screening, early diagnosis, determination of progression, therapy selection and treatment monitoring of marker-detectable disease and/or an indicative condition, including a transition from an indicative condition to marker-detectable disease.

According to some embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

In some embodiments of the present invention, there are provided of methods, uses, devices and assays for the diagnosis of a disease or condition. Optionally a plurality of biomarkers (or markers) may be used with the present invention. The plurality of markers may optionally include a plurality of markers described herein, and/or one or more known markers. The plurality of markers is preferably then correlated with the disease or condition. For example, such correlating may optionally comprise determining the concentration of each of the plurality of markers, and individually comparing each marker concentration to a threshold level. Optionally, if the marker concentration is above or below the threshold level (depending upon the marker and/or the diagnostic test being performed), the marker concentration correlates with the disease or condition. Optionally and preferably, a plurality of marker concentrations correlate with the disease or condition.

Alternatively, such correlating may optionally comprise determining the concentration of each of the plurality of markers, calculating a single index value based on the concentration of each of the plurality of markers, and comparing the index value to a threshold level.

Also alternatively, such correlating may optionally comprise determining a temporal change in at least one of the markers, and wherein the temporal change is used in the correlating step.

Also alternatively, such correlating may optionally comprise determining whether at least "X" number of the plurality of markers has a concentration outside of a predetermined range and/or above or below a threshold (as described above). The value of "X" may optionally be one marker, a plurality of markers or all of the markers; alternatively or additionally, rather than including any marker in the count for "X", one or more specific markers of the plurality of markers may optionally be required to correlate with the disease or condition (according to a range and/or threshold).

Also alternatively, such correlating may optionally comprise determining whether a ratio of marker concentrations for two markers is outside a range and/or above or below a threshold. Optionally, if the ratio is above or below the threshold level and/or outside a range, the ratio correlates with the disease or condition.

Optionally, a combination of two or more these correlations may be used with a single panel and/or for correlating between a plurality of panels.

Optionally, the method distinguishes a disease or condition with a sensitivity of at least 70% at a specificity of at least 85% when compared to normal subjects. As used herein, sensitivity relates to the number of positive (diseased) samples detected out of the total number of positive samples present; specificity relates to the number of true negative (non-diseased) samples detected out of the total number of negative samples present. Preferably, the method distinguishes a disease or condition with a sensitivity of at least 80% at a specificity of at least 90% when compared to normal subjects. More preferably, the method distinguishes a disease or condition with a sensitivity of at least 90% at a specificity of at least 90% when compared to normal subjects. Also more preferably, the method distinguishes a disease or condition with a sensitivity of at least 70% at a specificity of at least 85% when compared to subjects exhibiting symptoms that mimic disease or condition symptoms.

A marker panel may be analyzed in a number of fashions well known to those of skill in the art. For example, each member of a panel may be compared to a "normal" value, or a value indicating a particular outcome. A particular diagnosis/prognosis may depend upon the comparison of each marker to this value; alternatively, if only a subset of markers are outside of a normal range, this subset may be indicative of a particular diagnosis/prognosis. The skilled artisan will also understand that diagnostic markers, differential diagnostic markers, prognostic markers, time of onset markers, disease or condition differentiating markers, etc., may be combined in a single assay or device. Markers may also be commonly used for multiple purposes by, for example, applying a different threshold or a different weighting factor to the marker for the different purpose(s).

In one embodiment, the panels comprise markers for the following purposes: diagnosis of a disease; diagnosis of disease and indication if the disease is in an acute phase and/or if an acute attack of the disease has occurred; diagnosis of disease and indication if the disease is in a non-acute phase and/or if a non-acute attack of the disease has occurred; indication whether a combination of acute and non-acute phases or attacks has occurred; diagnosis of a disease and prognosis of a subsequent adverse outcome; diagnosis of a disease and prognosis of a subsequent acute or non-acute phase or attack; disease progression (for example for cancer, such progression may include for example occurrence or recurrence of metastasis).

The above diagnoses may also optionally include differential diagnosis of the disease to distinguish it from other diseases, including those diseases that may feature one or more similar or identical symptoms.

In certain embodiments, one or more diagnostic or prognostic indicators are correlated to a condition or disease by merely the presence or absence of the indicator(s). In other embodiments, threshold level(s) of a diagnostic or prognostic indicator(s) can be established, and the level of the indicator(s) in a patient sample can simply be compared to the threshold level(s). The sensitivity and specificity of a diagnostic and/or prognostic test depends on more than just the analytical "quality" of the test—they also depend on the definition of what constitutes an abnormal result. In practice, Receiver Operating Characteristic curves, or "ROC" curves, are typically calculated by plotting the value of a variable versus its relative frequency in "normal" and "disease" populations, and/or by comparison of results from a subject before, during and/or after treatment. For any particular marker, a distribution of marker levels for subjects with and without a disease will likely overlap. Under such conditions, a test does not absolutely distinguish normal from disease with 100% accuracy, and the area of overlap indicates where the test cannot distinguish normal from disease. A threshold is selected, above which (or below which, depending on how a marker changes with the disease) the test is considered to be abnormal and below which the test is considered to be normal. The area under the ROC curve is a measure of the probability that the perceived measurement will allow correct identification of a condition.

The horizontal axis of the ROC curve represents (1-specificity), which increases with the rate of false positives. The vertical axis of the curve represents sensitivity, which increases with the rate of true positives. Thus, for a particular cutoff selected, the value of (1-specificity) may be determined, and a corresponding sensitivity may be obtained. The area under the ROC curve is a measure of the probability that the measured marker level will allow correct identification of a disease or condition. Thus, the area under the ROC curve can be used to determine the effectiveness of the test.

ROC curves can be used even when test results don't necessarily give an accurate number. As long as one can rank results, one can create an ROC curve. For example, results of a test on "disease" samples might be ranked according to degree (say 1=low, 2=normal, and 3=high). This ranking can be correlated to results in the "normal" population, and a ROC curve created. These methods are well known in the art (see for example Hanley et al., Radiology 143: 29-36 (1982), incorporated by reference as if fully set forth herein).

One or more markers may lack diagnostic or prognostic value when considered alone, but when used as part of a panel, such markers may be of great value in determining a particular diagnosis/prognosis. In some embodiments, particular thresholds for one or more markers in a panel are not relied upon to determine if a profile of marker levels obtained from a subject are indicative of a particular diagnosis/prognosis. Rather, the present invention may utilize an evaluation of the entire marker profile by plotting ROC curves for the sensitivity of a particular panel of markers versus 1-(specificity) for the panel at various cutoffs. In these methods, a profile of marker measurements from a subject is considered together to provide a global probability (expressed either as a numeric score or as a percentage risk) that an individual has had a disease, is at risk for developing such a disease, optionally the type of disease which the individual has had or is at risk for, and so forth etc. In such embodiments, an increase in a certain subset of markers may be sufficient to indicate a particular diagnosis/prognosis in one patient, while an increase in a different subset of markers may be sufficient to indicate the same or a different diagnosis/prognosis in another patient. Weighting factors may also be applied to one or more markers in a panel, for example, when a marker is of particularly high utility in identifying a particular diagnosis/prognosis, it may be weighted so that at a given level it alone is sufficient to signal a positive result. Likewise, a weighting factor may provide that no given level of a particular marker is sufficient to signal a positive result, but only signals a result when another marker also contributes to the analysis.

In some embodiments, markers and/or marker panels are selected to exhibit at least 70% sensitivity, more preferably at least 80% sensitivity, even more preferably at least 85% sensitivity, still more preferably at least 90% sensitivity, and most preferably at least 95% sensitivity, combined with at least 70% specificity, more preferably at least 80% specificity, even more preferably at least 85% specificity, still more preferably at least 90% specificity, and most preferably at least 95% specificity. In some embodiments, both the sensitivity and specificity are at least 75%, more preferably at least 80%, even more preferably at least 85%, still more preferably at least 90%, and most preferably at least 95%. Sensitivity and/or specificity may optionally be determined as described above, with regard to the construction of ROC graphs and so forth, for example.

According to some embodiments of the present invention, individual markers and/or combinations (panels) of markers may optionally be used for diagnosis of time of onset of a disease or condition. Such diagnosis may optionally be useful for a wide variety of conditions, preferably including those conditions with an abrupt onset.

The phrase "determining the prognosis" as used herein refers to methods by which the skilled artisan can predict the course or outcome of a condition in a patient. The term "prognosis" does not refer to the ability to predict the course or outcome of a condition with 100% accuracy, or even that a given course or outcome is more likely to occur than not. Instead, the skilled artisan will understand that the term "prognosis" refers to an increased probability that a certain course or outcome will occur; that is, that a course or outcome is more likely to occur in a patient exhibiting a given condition, when compared to those individuals not exhibiting the condition. For example, in individuals not exhibiting the condition, the chance of a given outcome may be about 3%. In some embodiments, a prognosis is about a 5% chance of a given outcome, about a 7% chance, about a 10% chance, about a 12% chance, about a 15% chance, about a 20% chance, about a 25% chance, about a 30% chance, about a 40% chance, about a 50% chance, about a 60% chance, about a 75% chance, about a 90% chance, and about a 95% chance. The term "about" in this context refers to +/−1%.

The skilled artisan will understand that associating a prognostic indicator with a predisposition to an adverse outcome is a statistical analysis. For example, a marker level of greater than 80 pg/mL may signal that a patient is more likely to suffer from an adverse outcome than patients with a level less than or equal to 80 pg/mL, as determined by a level of statistical significance. Additionally, a change in marker concentration from baseline levels may be reflective of patient prognosis, and the degree of change in marker level may be related to the severity of adverse events. Statistical significance is often determined by comparing two or more populations, and determining a confidence interval and/or a p value. See, e.g., Dowdy and Wearden, Statistics for Research, John Wiley & Sons, New York, 1983. In one embodiment the confidence intervals of the invention are 90%, 95%, 97.5%, 98%, 99%, 99.5%, 99.9% and 99.99%, while preferred p values are 0.1, 0.05, 0.025, 0.02, 0.01, 0.005, 0.001, and 0.0001. Exemplary statistical tests for associating a prognostic indicator with a predisposition to an adverse outcome are described hereinafter.

In other embodiments, a threshold degree of change in the level of a prognostic or diagnostic indicator can be established, and the degree of change in the level of the indicator in a patient sample can simply be compared to the threshold degree of change in the level. A preferred threshold change in the level for markers of the invention is about 5%, about 10%, about 15%, about 20%, about 25%, about 30%, about 50%, about 75%, about 100%, and about 150%. The term "about" in this context refers to +/−10%. In yet other embodiments, a "nomogram" can be established, by which a level of a prognostic or diagnostic indicator can be directly related to an associated disposition towards a given outcome. The skilled artisan is acquainted with the use of such nomograms to relate two numeric values with the understanding that the uncertainty in this measurement is the same as the uncertainty in the marker concentration because individual sample measurements are referenced, not population averages.

Exemplary, non-limiting methods and systems for identification of suitable biomarkers for marker panels are now described. Methods and systems for the identification of one or more markers for the diagnosis, and in particular for the differential diagnosis, of disease have been described previously. Suitable methods for identifying markers useful for the diagnosis of disease states are described in detail in U.S. patent application no. 2004-0126767, entitled METHOD AND SYSTEM FOR DISEASE DETECTION USING MARKER COMBINATIONS, filed Dec. 27, 2002, hereby incorporated by reference in its entirety as if fully set forth herein. One skilled in the art will also recognize that univariate analysis of markers can be performed and the data from the univariate analyses of multiple markers can be combined to form panels of markers to differentiate different disease conditions.

In developing a panel of markers useful in diagnosis, data for a number of potential markers may be obtained from a group of subjects by testing for the presence or level of certain markers. The group of subjects is divided into two sets, and preferably the first set and the second set each have an approximately equal number of subjects. The first set includes subjects who have been confirmed as having a disease or, more generally, being in a first condition state. For example, this first set of patients may be those that have recently had a disease and/or a particular type of the disease. The confirmation of this condition state may be made through more rigorous and/or expensive testing, preferably according to a previously defined diagnostic standard. Hereinafter, subjects in this first set will be referred to as "diseased".

The second set of subjects are simply those who do not fall within the first set. Subjects in this second set may be "non-diseased;" that is, normal subjects. Alternatively, subjects in this second set may be selected to exhibit one symptom or a constellation of symptoms that mimic those symptoms exhibited by the "diseased" subjects.

The data obtained from subjects in these sets includes levels of a plurality of markers. Preferably, data for the same set of markers is available for each patient. This set of markers may include all candidate markers which may be suspected as being relevant to the detection of a particular disease or condition. Actual known relevance is not required. Embodiments of the methods and systems described herein may be used to determine which of the candidate markers are most relevant to the diagnosis of the disease or condition. The levels of each marker in the two sets of subjects may be distributed across a broad range, e.g., as a Gaussian distribution. However, no distribution fit is required.

As noted above, a marker often is incapable of definitively identifying a patient as either diseased or non-diseased. For example, if a patient is measured as having a marker level that falls within the overlapping region, the results of the test will be useless in diagnosing the patient. An artificial cutoff may be used to distinguish between a positive and a negative test result for the detection of the disease or condition. Regardless of where the cutoff is selected, the effectiveness of the single marker as a diagnosis tool is unaffected. Changing the cutoff merely trades off between the number of false positives and the number of false negatives resulting from the use of the single marker. The effectiveness of a test having such an overlap is often expressed using a ROC (Receiver Operating Characteristic) curve as described above.

As discussed above, the measurement of the level of a single marker may have limited usefulness. The measurement of additional markers provides additional information, but the difficulty lies in properly combining the levels of two potentially unrelated measurements. In the methods and systems according to embodiments of the present invention, data relating to levels of various markers for the sets of diseased and non-diseased patients may be used to develop a panel of markers to provide a useful panel response. The data may be provided in a database such as Microsoft Access, Oracle, other SQL databases or simply in a data file. The database or data file may contain, for example, a patient identifier such as a name or number, the levels of the various markers present, and whether the patient is diseased or non-diseased.

Next, an artificial cutoff region may be initially selected for each marker. The location of the cutoff region may initially be selected at any point, but the selection may affect the optimization process described below. In this regard, selection near a suspected optimal location may facilitate faster convergence of the optimizer. In an embodiment method, the cutoff region is initially centered about the center of the overlap region of the two sets of patients. In one embodiment, the cutoff region may simply be a cutoff point. In other embodiments, the cutoff region may have a length of greater than zero. In this regard, the cutoff region may be defined by a center value and a magnitude of length. In practice, the initial selection of the limits of the cutoff region may be determined according to a pre-selected percentile of each set of subjects. For example, a point above which a pre-selected percentile of diseased patients are measured may be used as the right (upper) end of the cutoff range.

Each marker value for each patient may then be mapped to an indicator. The indicator is assigned one value below the cutoff region and another value above the cutoff region. For example, if a marker generally has a lower value for non-diseased patients and a higher value for diseased patients, a zero indicator will be assigned to a low value for a particular marker, indicating a potentially low likelihood of a positive diagnosis. In other embodiments, the indicator may be calculated based on a polynomial. The coefficients of the polynomial may be determined based on the distributions of the marker values among the diseased and non-diseased subjects.

The relative importance of the various markers may be indicated by a weighting factor. The weighting factor may initially be assigned as a coefficient for each marker. As with the cutoff region, the initial selection of the weighting factor may be selected at any acceptable value, but the selection may affect the optimization process. In this regard, selection near a suspected optimal location may facilitate faster convergence of the optimizer. In an embodiment method, acceptable weighting coefficients may range between zero and one, and an initial weighting coefficient for each marker may be assigned as 0.5. In one embodiment, the initial weighting coefficient for each marker may be associated with the effectiveness of that marker by itself. For example, a ROC curve may be generated for the single marker, and the area under the ROC curve may be used as the initial weighting coefficient for that marker.

Next, a panel response may be calculated for each subject in each of the two sets. The panel response is a function of the indicators to which each marker level is mapped and the weighting coefficients for each marker. One advantage of using an indicator value rather than the marker value is that an extraordinarily high or low marker levels do not change the probability of a diagnosis of diseased or non-diseased for that particular marker. Typically, a marker value above a certain level generally indicates a certain condition state. Marker values above that level indicate the condition state with the same certainty. Thus, an extraordinarily high marker value may not indicate an extraordinarily high probability of that condition state. The use of an indicator which is constant on one side of the cutoff region eliminates this concern.

The panel response may also be a general function of several parameters including the marker levels and other factors including, for example, race and gender of the patient. Other factors contributing to the panel response may include the slope of the value of a particular marker over time. For example, a patient may be measured when first arriving at the hospital for a particular marker. The same marker may be measured again an hour later, and the level of change may be reflected in the panel response. Further, additional markers may be derived from other markers and may contribute to the value of the panel response. For example, the ratio of values of two markers may be a factor in calculating the panel response.

Having obtained panel responses for each subject in each set of subjects, the distribution of the panel responses for each set may now be analyzed. An objective function may be defined to facilitate the selection of an effective panel. The objective function should generally be indicative of the effectiveness of the panel, as may be expressed by, for example, overlap of the panel responses of the diseased set of subjects and the panel responses of the non-diseased set of subjects. In this manner, the objective function may be optimized to maximize the effectiveness of the panel by, for example, minimizing the overlap.

In a some embodiment, the ROC curve representing the panel responses of the two sets of subjects may be used to define the objective function. For example, the objective function may reflect the area under the ROC curve. By maximizing the area under the curve, one may maximize the effectiveness of the panel of markers. In other embodiments, other features of the ROC curve may be used to define the objective function. For example, the point at which the slope of the ROC curve is equal to one may be a useful feature. In other embodiments, the point at which the product of sensitivity and specificity is a maximum, sometimes referred to as the "knee," may be used. In an embodiment, the sensitivity at the knee may be maximized. In further embodiments, the sensitivity at a predetermined specificity level may be used to define the objective function. Other embodiments may use the specificity at a predetermined sensitivity level may be used. In still other embodiments, combinations of two or more of these ROC-curve features may be used.

It is possible that one of the markers in the panel is specific to the disease or condition being diagnosed. When such markers are present at above or below a certain threshold, the panel response may be set to return a "positive" test result. When the threshold is not satisfied, however, the levels of the marker may nevertheless be used as possible contributors to the objective function.

An optimization algorithm may be used to maximize or minimize the objective function. Optimization algorithms are well-known to those skilled in the art and include several commonly available minimizing or maximizing functions including the Simplex method and other constrained optimization techniques. It is understood by those skilled in the art that some minimization functions are better than others at searching for global minimums, rather than local minimums. In the optimization process, the location and size of the cutoff region for each marker may be allowed to vary to provide at least two degrees of freedom per marker. Such variable parameters are referred to herein as independent variables. In one embodiment, the weighting coefficient for each marker is also allowed to vary across iterations of the optimization algorithm. In various embodiments, any permutation of these parameters may be used as independent variables.

In addition to the above-described parameters, the sense of each marker may also be used as an independent variable. For example, in many cases, it may not be known whether a higher level for a certain marker is generally indicative of a diseased state or a non-diseased state. In such a case, it may be useful to allow the optimization process to search on both sides. In practice, this may be implemented in several ways. For example, in one embodiment, the sense may be a truly separate independent variable which may be flipped between positive and negative by the optimization process. Alternatively, the sense may be implemented by allowing the weighting coefficient to be negative.

The optimization algorithm may be provided with certain constraints as well. For example, the resulting ROC curve may be constrained to provide an area-under-curve of greater than a particular value. ROC curves having an area under the curve of 0.5 indicate complete randomness, while an area under the curve of 1.0 reflects perfect separation of the two sets. Thus, a minimum acceptable value, such as 0.75, may be used as a constraint, particularly if the objective function does not incorporate the area under the curve. Other constraints may include limitations on the weighting coefficients of particular markers. Additional constraints may limit the sum of all the weighting coefficients to a particular value, such as 1.0.

The iterations of the optimization algorithm generally vary the independent parameters to satisfy the constraints while minimizing or maximizing the objective function. The number of iterations may be limited in the optimization process. Further, the optimization process may be terminated when the difference in the objective function between two consecutive iterations is below a predetermined threshold, thereby indicating that the optimization algorithm has reached a region of a local minimum or a maximum.

Thus, the optimization process may provide a panel of markers including weighting coefficients for each marker and cutoff regions for the mapping of marker values to indicators. In order to develop lower-cost panels which require the measurement of fewer marker levels, certain markers may be eliminated from the panel. In this regard, the effective contribution of each marker in the panel may be determined to identify the relative importance of the markers. In one embodiment, the weighting coefficients resulting from the optimization process may be used to determine the relative importance of each marker. The markers with the lowest coefficients may be eliminated.

Individual panel response values may also be used as markers in the methods described herein. For example, a panel may be constructed from a plurality of markers, and each marker of the panel may be described by a function and a weighting factor to be applied to that marker (as determined by the methods described above). Each individual marker level is determined for a sample to be tested, and that level is applied to the predetermined function and weighting factor for that particular marker to arrive at a sample value for that marker. The sample values for each marker are added together to arrive at the panel response for that particular sample to be tested. For a "diseased" and "non-diseased" group of patients, the resulting panel responses may be treated as if they were just levels of another disease marker.

Measures of test accuracy may be obtained as described in Fischer et al., Intensive Care Med. 29: 1043-51, 2003 (hereby incorporated by reference as if fully set forth herein), and used to determine the effectiveness of a given marker or panel of markers. These measures include sensitivity and specificity, predictive values, likelihood ratios, diagnostic odds ratios, and ROC curve areas. As discussed above, suitable tests may exhibit one or more of the following results on these various measures: at least 75% sensitivity, combined with at least 75% specificity; ROC curve area of at least 0.7, more preferably at least 0.8, even more preferably at least 0.9, and most preferably at least 0.95; and/or a positive likelihood ratio (calculated as sensitivity/(1-specificity)) of at least 5, more preferably at least 10, and most preferably at least 20, and a negative likelihood ratio (calculated as (1-sensitivity)/specificity) of less than or equal to 0.3, more preferably less than or equal to 0.2, and most preferably less than or equal to 0.1.

According to embodiments of the present invention, a splice variant protein or a fragment thereof, or a splice variant nucleic acid sequence or a fragment thereof, may be featured as a biomarker for detecting marker-detectable disease and/or an indicative condition, such that a biomarker may optionally comprise any of the above.

According to still other embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Some embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466, 677; 5,476,925; 5,519,126; 5,536,821; 5,541,306; 5,550,111; 5,563,253; 5,571,799; 5,587,361; and 5,625,050.

Modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A)

and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., dihexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

In some embodiments, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264,166). The nucleic acid construct of the present invention can further include an enhancer, which can be adjacent or distant to the promoter sequence and can function in up regulating the transcription therefrom.

The nucleic acid construct of the present invention further includes, in some embodiments, an appropriate selectable marker and/or an origin of replication. In some embodiments, the nucleic acid construct utilized is a shuttle vector, which can propagate both in $E.\ coli$ (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

In some embodiments, in vivo nucleic acid transfer techniques include transfection with viral or non-viral constructs, such as adenovirus, lentivirus, retrovirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. Such vector constructs may comprise a packaging signal, long terminal repeats (LTRs) or portions thereof, and positive and negative strand primer binding sites appropriate to the virus used. In addition, such a construct may include a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs may include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Variant Recombinant Expression Vectors and Host Cells

Another aspect of the invention pertains to vectors, preferably expression vectors, containing a nucleic acid encoding a variant protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to include promoters, enhancers and other expression control elements (e.g., polyadenylation signals). Such regulatory sequences are described, for example, in Goeddel, Gene Expression Technology: Methods in Enzymology 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., variant proteins, mutant forms of variant proteins, fusion proteins, etc.).

The recombinant expression vectors of the invention can be designed for production of variant proteins in prokaryotic or eukaryotic cells. For example, variant proteins can be expressed in bacterial cells such as Escherichia coli, insect cells (using baculovirus expression vectors) yeast cells or mammalian cells. Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in Escherichia coli with vectors containing constitutive or inducible promoters directing the expression of either fusion or non-fusion proteins. Fusion vectors add a number of amino acids to a protein encoded therein, to the amino or carboxyl terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin, PreScission, TEV and enterokinase. Typical fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) and pTrcHis (Invitrogen Life Technologies) that fuse glutathione 5-transferase (GST), maltose E binding protein, protein A or 6xHis, respectively, to the target recombinant protein.

Examples of suitable inducible non-fusion E. coli expression vectors include pTrc (Amrann et al., (1988) Gene 69:301-315).

One strategy to maximize recombinant protein expression in E. coli is to express the protein in a host bacteria with an impaired capacity to proteolytically cleave the recombinant protein. See, e.g., Gottesman, Gene Expression Technology: Methods in Enzymology 185, Academic Press, San Diego, Calif. (1990) 119-128. Another strategy is to alter the nucleic acid sequence of the nucleic acid to be inserted into an expression vector so that the individual codons for each amino acid are those preferentially utilized in E. coli (see, e.g., Wada, et al., 1992. Nucl. Acids Res. 20: 2111-2118). Such alteration of nucleic acid sequences of the invention can be carried out by standard DNA synthesis techniques. Another optional strategy to solve codon bias is by using BL21-codon plus bacterial strains (Invitrogen) or Rosetta bacterial strain (Novagen), as these strains contain extra copies of rare E. coli tRNA genes.

In another embodiment, the expression vector encoding for the variant protein is a yeast expression vector. Examples of vectors for expression in yeast Saccharomyces cerivisae include pYepSec1 (Baldari, et al., 1987. EMBO J. 6: 229-234), pMFa (Kurjan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif.).

Alternatively, variant protein can be produced in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In yet another embodiment, a nucleic acid of the invention is expressed in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195), pIRESpuro (Clontech), pUB6 (Invitrogen), pCEP4 (Invitrogen) pREP4 (Invitrogen), pcDNA3 (Invitrogen). When used in mammalian cells, the expression vector's control functions are often provided by viral regulatory elements. For example, commonly used promoters are derived from polyoma, adenovirus 2, cytomegalovirus, Rous Sarcoma Virus, and simian virus 40. For other suitable expression systems for both prokaryotic and eukaryotic cells see, e.g., Chapters 16 and 17 of Sambrook, et al., Molecular Cloning: A Laboratory Manual. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol 43: 235-275), in particular promoters of T cell receptors (Winoto and Baltimore, 1989. EMBO J. 8: 729-733) and immunoglobulins (Banerji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the -fetoprotein promoter (Campes and Tilghman, 1989. Genes Dev. 3: 537-546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to mRNA encoding for variant protein. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," Reviews-Trends in Genetics, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, variant protein can be produced in bacterial cells such as E. coli, insect cells, yeast or mammalian cells (such as Chinese hamster ovary cells (CHO) or COS or 293 cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (Molecular Cloning: A Laboratory Manual. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin, puromycin, blasticidin and methotrexate. Nucleic acids encoding a selectable marker can be introduced into a host cell on the same vector as that encoding variant protein or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) variant protein. Accordingly, the invention further provides methods for producing variant protein using the host cells of the invention. In one embodiment, the method comprises culturing the host cell of the present invention (into which a recombinant expression vector encoding variant protein has been introduced) in a suitable medium such that variant protein is produced. In another embodiment, the method further comprises isolating variant protein from the medium or the host cell.

For efficient production of the protein, it is preferable to place the nucleotide sequences encoding the variant protein under the control of expression control sequences optimized for expression in a desired host. For example, the sequences may include optimized transcriptional and/or translational regulatory sequences (such as altered Kozak sequences).

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5\times10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1 SDS and $5\times10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1 SDS or 3 M TMACl, 0.01 M sodium phosphate (pH 6.8), 1 mM EDTA (pH 7.6), 0.5 SDS, 100 μg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5 SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5 SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5 SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one embodiment, RT-PCR is carried out on an mRNA sample from a patient under conditions which favor the amplification of the most abundant mRNA. In another embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qft replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3 SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a one embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Preferably, nucleic acid sequence homology/identity is determined by using BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids. Non-conventional or modified amino acids can be incorporated in the polypeptides of this invention as well, as will be known to one skilled in the art.

Since the peptides of the present invention are utilized, in some embodiments, in diagnostics which require the peptides to be in soluble form, the peptides of the present invention may include one or more non-natural or natural polar amino acids, including but not limited to serine and threonine which are capable of increasing peptide solubility due to their hydroxyl-containing side chain.

The peptides of the present invention may be utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies:

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Monoclonal antibody development may optionally be performed according to any method that is known in the art. The method described below is provided for the purposes of description only and is not meant to be limiting in any way.

Antibody Engineering in Phage Display Libraries:

Antibodies of this invention may be prepared through the use of phage display libraries, as is known in the art, for example, as described in PCT Application No. WO 94/18219, U.S. Pat. No. 6,096,551, both of which are hereby fully incorporated by reference, The method involves inducing mutagenesis in a complementarity determining region (CDR) of an immunoglobulin light chain gene for the purpose of producing light chain gene libraries for use in combination with heavy chain genes and gene libraries to produce antibody libraries of diverse and novel immuno-specificities. The method comprises amplifying a CDR portion of an immunoglobulin light chain gene by polymerase chain reaction (PCR) using a PCR primer oligonucleotide. The resultant gene portions are inserted into phagemids for production of a phage display library, wherein the engineered light chains are displayed by the phages, for example for testing their binding specificity.

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using Papain produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (1972)]. Alternatively, the variable chains can be linked by an inter-molecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. A scFv antibody fragment is an engineered antibody derivative that includes heavy- and light chain variable regions joined by a peptide linker. The minimal size of antibody molecules are those that still comprise the complete antigen binding site. ScFv antibody fragments are potentially more effective than unmodified IgG antibodies. The reduced size of 27-30 kDa permits them to penetrate tissues and solid tumors more readily. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)]. Optionally, there may be 1, 2 or 3 CDRs of different chains, but preferably there are 3 CDRs of 1 chain. The chain could be the heavy or the light chain.

Humanized forms of non-human (e.g., murine) antibodies, are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin, or fragments thereof may comprise the antibodies of this invention. Humanized antibodies are well known in the art. Methods for humanizing non-human antibodies are well known in the art, for example, as described in Winter and co-workers [Jones et al., Nature, 321:522-525 (1986); Riechmann et al., Nature 332:323-327 (1988); Verhoeyen et al., Science, 239:1534-1536 (1988)], U.S. Pat. No. 4,816,567, Hoogenboom and Winter, J. Mol. Biol., 227:381 (1991); Marks et al., J. Mol. Biol., 222:581 (1991), Cole et al., Monoclonal Antibodies and Cancer Therapy, Alan R. Liss, p. 77 (1985), Boerner et al., J. Immunol., 147(1):86-95 (1991), U.S. Pat. Nos. 5,545,807; 5,545,806; 5,569,825; 5,625,126; 5,633,425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol 13, 65-93 (1995), all of which are incorporated herein by reference.

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

In some embodiments, antibodies which specifically interact with the polypeptides of the present invention and not with wild type proteins or other iso forms thereof, are used. Such antibodies are directed, for example, to the unique sequence portions of the polypeptide variants of the present invention, including but not limited to bridges, heads, tails and insertions described in greater detail below. Some embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radio-labelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C R T al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

Theranostics:

The term theranostics describes the use of diagnostic testing to diagnose the disease, choose the correct treatment regime according to the results of diagnostic testing and/or monitor the patient response to therapy according to the results of diagnostic testing. Theranostic tests can be used to select patients for treatments that are particularly likely to benefit them and unlikely to produce side-effects. They can also provide an early and objective indication of treatment efficacy in individual patients, so that (if necessary) the treatment can be altered with a minimum of delay. For example: DAKO and Genentech together created HercepTest and Herceptin (trastuzumab) for the treatment of breast cancer, the first theranostic test approved simultaneously with a new therapeutic drug. In addition to HercepTest (which is an immunohistochemical test), other theranostic tests are in development which use traditional clinical chemistry, immunoassay, cell-based technologies and nucleic acid tests. PPGx's recently launched TPMT (thiopurine S-methyltransferase) test, which is enabling doctors to identify patients at risk for potentially fatal adverse reactions to 6-mercaptopurine, an agent used in the treatment of leukemia. Also, Nova Molecular pioneered SNP genotyping of the apolipoprotein E gene to predict Alzheimer's disease patients' responses to cholinomimetic therapies and it is now widely used in clinical trials of new drugs for this indication. Thus, the field of theranostics represents the intersection of diagnostic testing information that predicts the response of a patient to a treatment with the selection of the appropriate treatment for that particular patient.

Surrogate Markers:

A surrogate marker is a marker, that is detectable in a laboratory and/or according to a physical sign or symptom on the patient, and that is used in therapeutic trials as a substitute for a clinically meaningful endpoint. The surrogate marker is a direct measure of how a patient feels, functions, or survives which is expected to predict the effect of the therapy. The need for surrogate markers mainly arises when such markers can be measured earlier, more conveniently, or more frequently than the endpoints of interest in terms of the effect of a treatment on a patient, which are referred to as the clinical endpoints. Ideally, a surrogate marker should be biologically plausible, predictive of disease progression and measurable by standardized assays (including but not limited to traditional clinical chemistry, immunoassay, cell-based technologies, nucleic acid tests and imaging modalities).

Surrogate endpoints were used first mainly in the cardiovascular area. For example, antihypertensive drugs have been approved based on their effectiveness in lowering blood pressure. Similarly, in the past, cholesterol-lowering agents have been approved based on their ability to decrease serum cholesterol, not on the direct evidence that they decrease mortality from atherosclerotic heart disease. The measurement of cholesterol levels is now an accepted surrogate marker of atherosclerosis. In addition, currently two commonly used surrogate markers in HIV studies are CD4+ T cell counts and quantitative plasma HIV RNA (viral load). In some embodiments of this invention, the polypeptide/polynucleotide expression pattern may serve as a surrogate marker for a particular disease, as will be appreciated by one skilled in the art.

Monoclonal Antibody Therapy:

In some embodiments, monoclonal antibodies are useful for the identification of cancer cells. In some embodiments, monoclonal antibody therapy is a form of passive immunotherapy useful in cancer treatment. Such antibodies may comprise naked monoclonal antibodies or conjugated monoclonal antibodies—joined to a chemotherapy drug, radioactive particle, or a toxin (a substance that poisons cells). In some embodiments, the former is directly cytotoxic to the target (cancer) cell, or in another embodiment, stimulates or otherwise participates in an immune response ultimately resulting in the lysis of the target cell.

In some embodiments, the conjugated monoclonal antibodies are joined to drugs, toxins, or radioactive atoms. They are used as delivery vehicles to take those substances directly to the cancer cells. The MAb acts as a homing device, circulating in the body until it finds a cancer cell with a matching antigen. It delivers the toxic substance to where it is needed most, minimizing damage to normal cells in other parts of the body. Conjugated MAbs are also sometimes referred to as "tagged," "labeled," or "loaded" antibodies. MAbs with chemotherapy drugs attached are generally referred to as chemolabeled. MAbs with radioactive particles attached are referred to as radiolabeled, and this type of therapy is known as radioimmunotherapy (RIT). MAbs attached to toxins are called immunotoxins.

An illustrative, non-limiting example is provided herein of a method of treatment of a patient with an antibody to a variant as described herein, such that the variant is a target of the antibody. A patient with breast cancer is treated with a radiolabeled humanized antibody against an appropriate breast cancer target as described herein. The patient is optionally treated with a dosage of labeled antibody ranging from 10 to 30 mCi. Of course any type of therapeutic label may optionally be used.

The following sections relate to Candidate Marker Examples. It should be noted that Table numbering is restarted within each Example, which starts with the words "Description for Cluster".

Candidate Marker Examples Section

This Section relates to Examples of sequences according to the present invention, including illustrative methods of selection thereof with regard to cancer; other markers were selected as described below for the individual markers.

Description of the methodology undertaken to uncover the biomolecular sequences of the present invention Human ESTs and cDNAs were obtained from GenBank versions 136 (Jun. 15, 2003); NCBI genome assembly of April 2003; RefSeq sequences from June 2003; Genbank version 139 (December 2003); Human Genome from NCBI (Build 34) (from October 2003); and RefSeq sequences from December 2003. With regard to GenBank sequences, the human EST sequences from the EST (GBEST) section and the human mRNA sequences from the primate (GBPRI) section were used; also the human nucleotide RefSeq mRNA sequences were used (see a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625, 545; and U.S. patent application Ser. No. 10/426,002, published as US20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should be noted that this explanation is provided for descriptive purposes only, and is not intended to be limiting in any way. The potential markers were identified by a computational process that was designed to find genes and/or their splice variants that are specifically expressed in cardiac tissue, as opposed to other types of tissues and also particularly as opposed to muscle tissue, by using databases of expressed sequences. Various parameters related to the information in the EST libraries, determined according to classification by library annotation, were used to assist in locating genes and/or splice variants thereof that are specifically and/or differentially expressed in heart tissues. The detailed description of the selection method and of these parameters is presented in Example 1 below.

Selecting Candidates with Regard to Cancer

A brief explanation is provided with regard to a non-limiting method of selecting the candidates for cancer diagnostics. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

EXAMPLE 1

Identification of Differentially Expressed Gene Products—Algorithm

In order to distinguish between differentially expressed gene products and constitutively expressed genes (i.e., house keeping genes), an algorithm based on an analysis of frequencies was configured. A specific algorithm for identification of transcripts specifically expressed in heart tissue is described hereinbelow.

EST Analysis

ESTs were taken from the following main sources: libraries contained in Genbank version 136 (Jun. 15, 2003 ftp.ncbi.nih.gov/genbank/release.notes/gb136.release.notes) and Genbank version 139 (December 2003); and from the LifeSeq library of Incyte Corporation (ESTs only; Wilmington, Del., USA). With regard to GenBank sequences, the human EST sequences from the EST (GBEST) section were used.

Library annotation—EST libraries were manually classified according to:
1. Tissue origin
2. Biological source—Examples of frequently used biological sources for construction of EST libraries include cancer cell-lines; normal tissues; cancer tissues; foetal tissues; and others such as normal cell lines and pools of normal cell-lines, cancer cell-lines and combinations thereof. A specific description of abbreviations used below with regard to these tissues/cell lines etc is given above.
3. Protocol of library construction—various methods are known in the art for library construction including normalized library construction; non-normalized library construction; subtracted libraries; ORESTES and others (described in the annotation available in Genbank). It will be appreciated that at times the protocol of library construction is not indicated in the information available about that library.

The following rules were followed:

EST libraries originating from identical biological samples were considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above

EXAMPLE 2

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm—

Clone counting: For counting EST clones each library protocol class was given a weight based on an assessment of how much the protocol reflects actual expression levels:
(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{c+1}{C} \Big/ \frac{n+1}{N}$$

where:
c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

EXAMPLE 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and
2. Clones from the tissue T are at least 40% from all the clones participating in the tested cluster Fisher exact test P-values were computed both for library and weighted clone counts to check that the counts are statistically significant.

EXAMPLE 4

Identification of Splice Variants Over Expressed in Cancer of Clusters which are not Over Expressed in Cancer Cancer-specific splice variants containing a unique region were identified.

Identification of Unique Sequence Regions in Splice Variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:
(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:
(i) Aligned to the genome; and
(ii) Regions supported by more than 2 ESTs.

The algorithm

Each unique sequence region divides the set of transcripts into 2 groups:
(i) Transcripts containing this region (group TA).
(ii) Transcripts not containing this region (group TB).

The set of EST clones of every cluster is divided into 3 groups:
(i) Supporting (originating from) transcripts of group TA (S1).
(ii) Supporting transcripts of group TB (S2).
(iii) Supporting transcripts from both groups (S3).

Library and clones number scores described above were given to 51 group.

Fisher Exact Test P-values were used to check if:
S1 is significantly enriched by cancer EST clones compared to S2; and
S1 is significantly enriched by cancer EST clones compared to cluster background (S1+S2+S3).

Figure 2:
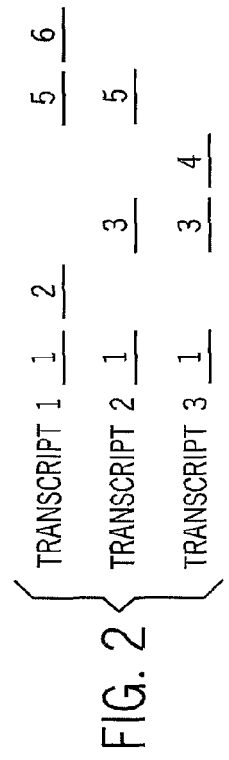
FIG. 2: Schematic illustration, depicting grouping of transcripts of a given cluster based on presence or absence of unique sequence regions.

Identification of unique sequence regions and division of the group of transcripts accordingly is illustrated in FIG. 2. Each of these unique sequence regions corresponds to a segment, also termed herein a "node".

Region 1: common to all transcripts, thus it is not considered; Region 2: specific to Transcript 1: T_1 unique regions (2+6) against T_2+3 unique regions (3+4); Region 3: specific to Transcripts 2+3: T_2+3 unique regions (3+4) against T1 unique regions (2+6); Region 4: specific to Transcript 3: T_3 unique regions (4) against T1+2 unique regions (2+5+6); Region 5: specific to Transcript 1+2: T_1+2 unique regions (2+5+6) against T3 unique regions (4); Region 6: specific to Transcript 1: same as region 2.

EXAMPLE 5

Diseases and Conditions that May be Diagnosed with One or More Variant(s) According to the Present Invention Cardiovascular and Cerebrovascular Conditions Various examples are listed below for conditions that affect the vascular system, including various cardiovascular and cerebrovascular conditions, for which one or more variants according to the present invention may have a diagnostic utility. Based on these diseases mechanisms and the correlation between the known proteins and the cardiovascular and cerebrovascular conditions, such correlation was predicted also for one or more variants according to the present invention, as described below. Each variant marker of the present invention described herein as potential marker for cardiovascular conditions, might optionally be used alone or in combination with one or more other variant markers described herein, and or in combination with known markers for cardiovascular conditions, including but not limited to Heart-type fatty acid binding protein (H-FABP), Angiotensin, C-reactive protein (CRP), myeloperoxidase (MPO), and/or in combination with the known protein(s) for the variant marker as described herein. Each variant marker of the present invention described herein as potential marker for cerebrovascular conditions, might optionally be used alone or in combination with one or more other variant markers described herein, and or in combination with known markers for cerebrovascular conditions, including but not limited to CRP, S100b, BNGF, CD40, MCP1, N-Acetyl-Aspartate (NAA), N-methyl-d-aspartate (NMDA) receptor antibodies (NR2Ab), and/or in combination with the known protein(s) for the variant marker as described herein.

Myocardial Infarction

HSFLT variants, HSI1Ra variants, HSPLGF variants, HUMSP18A variants, F05068 variants and/or HUMIL10 variants are potential markers for myocardial infarction. Other conditions that may be diagnosed by these markers or variants of them include but are not limited to the presence, risk and/or extent of the following:

1. Myocarditis—in myocarditis cardiac muscle cells can go through cell lysis and leakage with the release of intracellular content to the extracellular space and blood, a similar process as happens in myocardial infarction (see also extended description below).
2. Angina—stable or unstable, as the reduction of oxygen delivery to part of the heart often leads to local ischemic conditions that facilitate leakage of intracellular content.
3. Traumatic injury to myocardial tissue—blunt or penetrating, may also result in myocardial cell leakage.
4. Opening an occluded coronary artery following thrombolytic therapy—If such treatment is successful, proteins and other products of the local tissue are washed into the blood and can be detected there.
5. Cardiomyopathy—which is characterized by slow degeneration of the heart muscle (see also extended description below).
6. Myocardial injury after rejection of heart transplant.
7. Congestive heart failure where heart myocytes slowly degenerate (as had been shown for Troponin-I; see also extended description below).
8. Future cardiovascular disease (as a risk factor).
9. Conditions which have similar clinical symptoms as myocardial infarction and where the differential diagnosis between them and myocardial infarction is of clinical importance including but not limited to:
    a. Clinical symptoms resulting from lung related tissue (e.g. Pleuritis, pulmonary embolism)
    b. Musculoskeletal origin of pain
    c. Clinical symptoms resulting from heart related tissue which are not due to myocardial infarction, e.g. acute pericarditis
    d. Upper abdominal pain from abdominal organs including but nor limited to esophagitis, gastro-esophageal reflux, gastritis, gastric ulcer, duodenitis, duodenal ulcer, enteritis, gastroenteritis, cholecystitis, cholelithiasis, cholangiolithiasis, pancreatitis, splenic infarction, splenic trauma, Aortic dissection.

One or more of these markers (variants according to the present invention) may optionally be used a tool to decide on treatment options e.g. anti platelet inhibitors (as has been shown for Troponin-I); as a tool in the assessment of pericardial effusion; and/or as a tool in the assessment of endocarditis and/or rheumatic fever, where progressive damage to the heart muscle may occur.

Acute and Chronic Inflammation and Risk Factors for CVS Diseases

HSFLT variants, HSI1Ra variants, HSPLGF variants, HUMSP18A variants, F05068 variants and/or HUMIL10 variants are potential markers for inflammation, including a spectrum of diseases where an inflammatory process plays a substantial role. In addition CRP levels and in particular baseline levels serve as a risk factor for various diseases, particularly cardiovascular diseases where inflammation is thought to participate in the pathogenesis. Conditions that may be diagnosed by these markers or variants of them include but are not limited to the presence, risk and/or extent of the following:
1. Conditions that entail an inflammatory process that involves blood vessels including but not limited to hypercholesterolemia, diabetes, atherosclerosis, inflammation that involves blood vessels—whether acute or chronic including but not limited to the coronary arteries and blood vessels of the brain, myocardial infarction, cerebral stroke, peripheral vascular disease, vasculitis, polyarteritis nodosa, ANCA associated small vessel vasculitis, Churg-Strauss syndrome, Henoch-Schonlein purpura, scleroderma, thromboangiitis obliterans, temporal arteritis, Takayasu's arteritis, hypersensitivity vasculitis, Kawasaki disease, Behçet syndrome, and their complications including but not limited to coronary disease, angina pectoris, deep vein thrombosis, renal disease, diabetic nephropathy, lupus nephritis, renal artery thrombosis, renal artery stenosis, atheroembolic disease of the renal arteries, renal vein thrombosis, hemolytic uremic syndrome, thrombotic thrombocytopenic purpura, arteriolar nephrosclerosis, preeclampsia, eclampsia, albuminuria, microalbuminuria, glomerulonephritis, renal failure, hypertension, uremia, cerebrovascular disease, peripheral vascular disease, intermittent claudication, abdominal angina.
2. Rheumatic/autoimmune diseases that involve systemic immune reaction including but not limited to rheumatoid arthritis, scleroderma, mixed connective tissue disease, Sjogren syndrome, ankylosing spondylitis, spondyloarthropathy, psoriasis, psoriatic arthritis, myositis and systemic lupus erythematosus.
3. Acute and/or chronic infective processes that involve systemic immune reaction including but not limited to pneumonia, bacteremia, sepsis, pyelonephritis, cellulitis, osteomyelitis, meningitis and viral hepatitis.
4. Malignant and idiopathic processes that involve systemic immune reaction and/or proliferation of immune cells including but not limited to granulomatous disorders, Wegener's granulomatosis, lymphomatoid granulomatosis/polymorphic reticulosis, idiopathic midline granuloma, multiple myeloma, Waldenstrom's macroglobulinemia, Castleman's disease, amyloidosis, lymphoma, histiocytosis, renal cell carcinoma and paraneoplastic syndromes.
5. Conditions where CRP was shown to have a positive correlation with the presence of the condition including but not limited to weight loss, anorexia-cachexia syndrome, extent of disease, recurrence in advanced cancer, diabetes (types 1 & 2), obesity, hypertension, preterm delivery.
6. Conditions which have similar symptoms, signs and complications as the conditions above and where the differential diagnosis between them and the conditions above is of clinical importance including but not limited to:
    a. Other (non vascular) causes of heart disease, renal disease and cerebral disease.
    b. Other (non rheumatic) causes of arthropathy and musculoskeletal pain.
    c. Other causes of non-specific symptoms and signs such as fever of unknown origin, loss of appetite, weight loss, nonspecific pains, breathing difficulties and anxiety.

Stroke

Stroke is a manifestation of vascular injury to the brain which is commonly secondary to atherosclerosis or hypertension, and is the third leading cause of death (and the second most common cause of neurologic disability) in the United States. Embodiments of marker(s) for diagnosis of stroke and related conditions as described herein may optionally be selected from the group consisting of HSFLT variants, HSI1Ra variants, HSPLGF variants, HUMSP18A variants, F05068 variants and/or HUMIL10 variants or markers related thereto.

Specific markers of neural tissue injury are found in the blood or in blood components such as serum and plasma, as well as the CSF of a patient experiencing stroke or TIAs. Furthermore, clearance of the obstructing object in ischemic stroke can cause injury from oxidative insult during reperfusion, and patients with ischemic stroke can sometimes experience hemorrhagic transformation as a result of reperfusion or thrombolytic therapy.

Fibrinolysis is the process of proteolytic clot dissolution. In a manner analogous to coagulation, fibrinolysis is mediated by serine proteinases that are activated from their zymogen form. The serine proteinase plasmin is responsible for the degradation of fibrin into smaller degradation products that are liberated from the clot, resulting in clot dissolution. Fibrinolysis is activated soon after coagulation in order to regulate clot formation. Endogenous serine proteinase inhibitors also function as regulators of fibrinolysis.

The presence of a coagulation or fibrinolysis marker in cerebrospinal fluid would indicate that activation of coagulation or fibrinolysis, depending upon the marker used, coupled with increased permeability of the blood-brain barrier has occurred. In this regard, more definitive conclusions regarding the presence of coagulation or fibrinolysis markers associated with acute stroke may be obtained using cerebrospinal fluid.

Stroke can be categorized into two broad types, "ischemic stroke" and "hemorrhagic stroke." Additionally, a patient may experience transient ischemic attacks, which are in turn a high risk factor for the future development of a more severe episode.

Ischemic stroke encompasses thrombotic, embolic, lacunar and hypoperfusion types of strokes. Thrombi are occlusions of arteries created in situ within the brain, while emboli are occlusions caused by material from a distant source, such as the heart and major vessels, often dislodged due to myocardial infarct or atrial fibrillation. Less frequently, thrombi may also result from vascular inflammation due to disorders such as meningitis. Thrombi or emboli can result from atherosclerosis or other disorders, for example, arteritis, and lead to physical obstruction of arterial blood supply to the brain. Lacunar stroke refers to an infarct within non-cortical regions of the brain. Hypoperfusion embodies diffuse injury caused by non-localized cerebral ischemia, typically caused by myocardial infarction and arrhythmia.

The onset of ischemic stroke is often abrupt, and can become an "evolving stroke" manifested by neurologic deficits that worsen over a 24-48 hour period. In evolving stroke, "stroke-associated symptom(s)" commonly include unilateral neurologic dysfunction which extends progressively, without producing headache or fever. Evolving stroke may also become a "completed stroke," in which symptoms develop rapidly and are maximal within a few minutes.

Hemorrhagic stroke is caused by intracerebral or subarachnoid hemorrhage, i.e., bleeding into brain tissue, following blood vessel rupture within the brain. Intracerebral and subarachnoid hemorrhage are subsets of a broader category of hemorrhage referred to as intracranial hemorrhage. Intracerebral hemorrhage is typically due to chronic hypertension, and a resulting rupture of an arteriosclerotic vessel. Stroke-associated symptom(s) of intracerebral hemorrhage are abrupt, with the onset of headache and steadily increasing neurological deficits. Nausea, vomiting, delirium, seizures and loss of consciousness are additional common stroke-associated symptoms.

In contrast, most subarachnoid hemorrhage is caused by head trauma or aneurysm rupture which is accompanied by high pressure blood release which also causes direct cellular trauma. Prior to rupture, aneurysms may be asymptomatic, or occasionally associated with tension or migraine headaches. However, headache typically becomes acute and severe upon rupture, and may be accompanied by varying degrees of neurological deficit, vomiting, dizziness, and altered pulse and respiratory rates.

Transient ischemic attacks (TIAs) have a sudden onset and brief duration, typically 2-30 minutes. Most TIAs are due to emboli from atherosclerotic plaques, often originating in the arteries of the neck, and can result from brief interruptions of blood flow. The symptoms of TIAs are identical to those of stroke, but are only transient. Concomitant with underlying risk factors, patients experiencing TIAs are at a markedly increased risk for stroke.

Current diagnostic methods for stroke include costly and time-consuming procedures such as noncontrast computed tomography (CT) scan, electrocardiogram, magnetic resonance imaging (MRI), and angiography. Determining the immediate cause of stroke and differentiating ischemic from hemorrhagic stroke is difficult. CT scans can detect parenchymal bleeding greater than 1 cm and 95% of all subarachnoid hemorrhages. CT scan often cannot detect ischemic strokes until 6 hours from onset, depending on the infarct size. MRI may be more effective than CT scan in early detection of ischemic stroke, but it is less accurate at differentiating ischemic from hemorrhagic stroke, and is not widely available. An electrocardiogram (ECG) can be used in certain circumstances to identify a cardiac cause of stroke. Angiography is a definitive test to identify stenosis or occlusion of large and small cranial blood vessels, and can locate the cause of subarachnoid hemorrhages, define aneurysms, and detect cerebral vasospasm. It is, however, an invasive procedure that is also limited by cost and availability. Coagulation studies can also be used to rule out a coagulation disorder (coagulopathy) as a cause of hemorrhagic stroke.

Immediate diagnosis and care of a patient experiencing stroke can be critical. For example, tissue plasminogen activator (TPA) given within three hours of symptom onset in ischemic stroke is beneficial for selected acute stroke patients. Alternatively, patients may benefit from anticoagulants (e.g., heparin) if they are not candidates for TPA therapy. In contrast, thrombolytics and anticoagulants are strongly contraindicated in hemorrhagic strokes. Thus, early differentiation of ischemic events from hemorrhagic events is imperative. Moreover, delays in the confirmation of stroke diagnosis and the identification of stroke type limit the number of patients that may benefit from early intervention therapy. Finally, there are currently no diagnostic methods that can identify a TIA, or predict delayed neurological deficits which are often detected at a time after onset concurrent with the presentation of symptoms.

Accordingly, there is a present need in the art for a rapid, sensitive and specific diagnostic assay for stroke and TIA that can also differentiate the stroke type and identify those individuals at risk for delayed neurological deficits. Such a diagnostic assay would greatly increase the number of patients that can receive beneficial stroke treatment and therapy, and reduce the costs associated with incorrect stroke diagnosis.

The present invention relates to the identification and use of diagnostic markers for stroke and neural tissue injury. The methods and compositions described herein can meet the need in the art for rapid, sensitive and specific diagnostic assay to be used in the diagnosis and differentiation of various forms of stroke and TIAs. Moreover, the methods and compositions of the present invention can also be used to facilitate the treatment of stroke patients and the development of additional diagnostic and/or prognostic indicators.

In various aspects, the invention relates to materials and procedures for identifying markers that are associated with the diagnosis, prognosis, or differentiation of stroke and/or TIA in a patient; to using such markers in diagnosing and treating a patient and/or to monitor the course of a treatment regimen; to using such markers to identify subjects at risk for one or more adverse outcomes related to stroke and/or TIA; and for screening compounds and pharmaceutical compositions that might provide a benefit in treating or preventing such conditions.

In a first aspect, the invention discloses methods for determining a diagnosis or prognosis related to stroke, or for differentiating between types of strokes and/or TIA. These methods comprise analyzing a test sample obtained from a subject for the presence or amount of one or more markers for neural tissue injury. These methods can comprise identifying one or more markers, the presence or amount of which is associated with the diagnosis, prognosis, or differentiation of stroke and/or TIA. Once such marker(s) are identified, the level of such marker(s) in a sample obtained from a subject of interest can be measured. In certain embodiments, these markers can be compared to a level that is associated with the diagnosis, prognosis, or differentiation of stroke and/or TIA. By correlating the subject's marker level(s) to the diagnostic marker level(s), the presence or absence of stroke, the probability of future adverse outcomes, etc., in a patient may be rapidly and accurately determined.

In a related aspect, the invention discloses methods for determining the presence or absence of a disease in a subject that is exhibiting a perceptible change in one or more physical characteristics (that is, one or more "symptoms") that are indicative of a plurality of possible etiologies underlying the observed symptom(s), one of which is stroke. These methods comprise analyzing a test sample obtained from the subject for the presence or amount of one or more markers selected to rule in or out stroke, or one or more types of stroke, as a possible etiology of the observed symptom(s). Etiologies other than stroke that are within the differential diagnosis of the symptom(s) observed are referred to herein as "stroke mimics", and marker(s) able to differentiate one or more types of stroke from stroke mimics are referred to herein as "stroke differential diagnostic markers". The presence or amount of such marker(s) in a sample obtained from the subject can be used to rule in or rule out one or more of the following: stroke, thrombotic stroke, embolic stroke, lacunar stroke, hypoperfusion, intracerebral hemorrhage, and subarachnoid hemorrhage, thereby either providing a diagnosis (rule-in) and/or excluding a diagnosis (rule-out).

Obtaining information on the true time of onset can be critical, as early treatments have been reported to be critical for proper treatment. Obtaining this time-of-onset information may be difficult, and is often based upon interviews with companions of the stroke victim. Thus, in various embodiments, markers and marker panels are selected to distinguish the approximate time since stroke onset. For purposes of the present invention, the term "acute stroke" refers to a stroke that has occurred within the prior 12 hours, more preferably within the prior 6 hours, and most preferably within the prior 3 hours; while the term "non-acute stroke" refers to a stroke that has occurred more than 12 hours ago, preferably between 12 and 48 hours ago, and most preferably between 12 and 24 hours ago. Embodiments of markers for differentiating between acute and non-acute strokes, referred to herein as stroke "time of onset markers" are described hereinafter.

For markers appearing in the patent which are already linked to stroke, either ischemic or hemorrhagic, variants could also help to diagnose, directly or by elimination of other conditions including but not limited to:
1. Transient ischemic attack
2. Brain trauma, in case it is unclear whether accompanied by stroke or not
3. Migraine
4. Bleeding in any part of the brain or inside the skull that cause or didn't cause damage to brain tissue
5. Tumor In addition, such markers may help determine:
1. The time of stroke
2. The type of stroke
3. The extent of tissue damage as a result of the stroke
4. Response to immediate treatments that are meant to alleviate the extent of stroke and brain damage, when available.

With regard to stroke, according to embodiments of the present invention, the panel may optionally and preferably provide diagnosis of stroke and indication if an ischemic stroke has occurred; diagnosis of stroke and indication if a hemorrhagic stroke has occurred; diagnosis of stroke, indication if an ischemic stroke has occurred, and indication if a hemorrhagic stroke has occurred; diagnosis of stroke and prognosis of a subsequent cerebral vasospasm; and diagnosis of stroke, indication if a hemorrhagic stroke has occurred, and prognosis of a subsequent cerebral vasospasm.

According to other optional embodiments of the present invention, there are provided methods of identifying a patient at risk for cerebral vasospasm. Such methods preferably comprise comparing an amount of one or more marker(s) predictive of a subsequent cerebral vasospasm in a test sample from a patient diagnosed with a subarachnoid hemorrhage. Such markers may be one or more markers related to blood pressure regulation, markers related to inflammation, markers related to apoptosis, and/or specific markers of neural tissue injury. As discussed herein, such marker may be used in panels comprising 2, 3, 4, 5, 6, 7, 8, 9, 10, 15, 20, or more or individual markers. Embodiments of marker(s) may be selected from the group consisting of HSFLT variants, HSI1Ra variants, HSPLGF variants, HUMSP18A variants, F05068 variants and/or HUMIL10 variants or markers related thereto. The levels of one or more markers may be compared to a predictive level of said marker(s), wherein said patient is identified as being at risk for cerebral vasospasm by a level of said marker(s) equal to or greater than said predictive level. In the alternative, a panel response value for a plurality of such markers may be determined, optionally considering a change in the level of one or more such markers as an additional independent marker.

According to yet other embodiments of the present invention, there are provided methods of differentiating ischemic stroke from hemorrhagic stroke using such marker panels.

Cardiomyopathy and Myocarditis

Cardiomyopathy may be treated with the polynucleotides/polypeptides and/or methods of this invention. Cardiomyopathy is a general diagnostic term designating primary myocardial disease which may progress to heart failure. The disease comprises inflammatory cardiomyopathies, cardiomyopathies resulting from a metabolic disorder such as a nutritional deficiency or by altered endocrine function, exposure to toxic substances, for example from alcohol or exposure to cobalt or lead, infiltration and deposition of abnormal. In some embodiments, the marker(s) for diagnosis of cardiomyopathy and myocarditis, and related conditions as described herein, may optionally be selected from the group consisting of HSFLT variants, HSI1Ra variants, HSPLGF variants, HUMSP18A variants, F05068 variants and/or HUMIL10 variants Congestive Heart Failure (CHF)

HSFLT variants, HSI1Ra variants, HSPLGF variants, HUMSP18A variants, F05068 variants and/or HUMIL10 variants are potential markers for, and may be used to treat, etc., CHF.

The invention provides a means for the identification/prognostication, etc., of a number of conditions including the assessment of the presence, risk and/or extent of the following:
1. A risk factor for sudden cardiac death, from arrhythmia or any other heart related reason.

2. Rejection of a transplanted heart.
3. Conditions that lead to heart failure including but not limited to myocardial infarction, angina, arrhythmias, valvular diseases, atrial and/or ventricular septal defects.
4. Conditions that cause atrial and or ventricular wall volume overload. Wall stretch results in enhanced secretion of cardiac extracellular regulators. Such conditions include but are not limited to systemic arterial hypertension, pulmonary hypertension and pulmonary embolism.
5. Conditions which have similar clinical symptoms as heart failure and as states that cause atrial and or ventricular pressure-overload, where the differential diagnosis between these conditions to the latter is of clinical importance including but not limited to breathing difficulty and/or hypoxia due to pulmonary disease, anemia or anxiety.

Cancerous Conditions

Various non-limiting examples are given below of cancerous conditions for which one or more variants according to the present invention may have a diagnostic, or therapeutic utility.

Ovarian Cancer

Ovarian cancer causes more deaths than any other cancer of the female reproductive system, however, only 25% of ovarian cancers are detected in stage I. No single marker has been shown to be sufficiently sensitive or specific to contribute to the diagnosis of ovarian cancer.

In one embodiment, the markers of this invention are utilized alone, or in combination with other markers, for the diagnosis, treatment or assessment of prognosis of ovarian cancer. Such other markers may comprise CA-125 or mucin 16, CA-50, CA 54-61, CA-195 and CA 19-9, STN and TAG-72, kallikreins, cathepsin L, urine gonadotropin, inhibins, cytokeratins, such as TPA and TPS, members of the Transforming Growth Factors (TGF) beta superfamily, Epidermal Growth Factor, p53 and HER-2 or any combination thereof.

Immunohistochemistry may be used to assess the origin of the tumor and staging as part of the methods of this invention, and as protected uses for the polypeptides of this invention.

In some embodiments, this invention provides polypeptides/polynucleotides which serves as markers for ovarian cancer. In some embodiments, the marker is any polypeptide/polynucleotide as described herein. In some embodiments, the marker is an HSFLT, Z25299 or variants as described herein or markers related thereto. Each variant marker of the present invention described herein may be used alone or in combination with one or more other variant ovarian cancer described herein, and/or in combination with known markers for ovarian cancer, as described herein. Diagnosis of ovarian cancer and or of other conditions that may be diagnosed by these markers or variants of them include but are not limited to the presence, risk and/or extent of the following:

1. The identification of a metastasis of unknown origin which originated from a primary ovarian cancer, for example gastric carcinoma (such as Krukenberg tumor), breast cancer, colorectal carcinoma and pancreatic carcinoma.
2. As a marker to distinguish between different types of ovarian cancer, therefore potentially affect treatment choice (e.g. discrimination between epithelial tumors and germ cell tumors).
3. As a tool in the assessment of abdominal mass and in particular in the differential diagnosis between a benign and malignant ovarian cysts.
4. As a tool for the assessment of infertility.
5. Other conditions that may elevate serum levels of ovary related markers. These include but are not limited to: cancers of the endometrium, cervix, fallopian tubes, pancreas, breast, lung and colon; nonmalignant conditions such as pregnancy, endometriosis, pelvic inflammatory disease and uterine fibroids.
6. Conditions which have similar symptoms, signs and complications as ovarian cancer and where the differential diagnosis between them and ovarian cancer is of clinical importance including but not limited to:
   a. Non-malignant causes of pelvic mass. Including, but not limited to: benign (functional) ovarian cyst, uterine fibroids, endometriosis, benign ovarian neoplasms and inflammatory bowel lesions
   b. Any condition suggestive of a malignant tumor including but not limited to anorexia, cachexia, weight loss, fever, hypercalcemia, skeletal or abdominal pain, paraneoplastic syndrome.
   c. Ascites.
7. Prediction of patient's drug response
8. As surrogate markers for clinical outcome of a treated cancer.

Breast Cancer

Breast cancer is the most commonly occurring cancer in women, comprising almost a third of all malignancies in females. In one embodiment, the polypeptides and/or polynucleotides of this invention are utilized alone, or in combination with other markers, for the diagnosis, treatment or assessment of prognosis of breast cancer. In one embodiment, the polypeptides and/or polynucleotides serve as markers of disease.

Such markers may be used alone, or in combination with other known markers for breast cancer, including, inter alia, Mucin1 (measured as CA 15-3), CEA (CarcinoEmbryonic Antigen), HER-2, CA125, CA 19-9, PCNA, Ki-67, E-Cadherin, Cathepsin D, TFF1, epidermal growth factor receptor (EGFR), cyclin E, p53, bcl-2, vascular endothelial growth factor, urokinase-type plasminogen activator-1, survivin, or any combination thereof, and includes use of any compound which detects or quantifies the same. ESR (Erythrocyte Sedimentation Rate) values may be obtained, and comprise the marker panel for breast cancer.

In some embodiments, the polypeptides/polynucleotides of this invention serve as prognosticators, in identifying, inter alia, patients at minimal risk of relapse, patients with a worse prognosis, or patients likely to benefit from specific treatments.

There are some non-cancerous pathological conditions which represent an increased risk factor for development breast cancer, and as such, patients with these conditions may be evaluated using the polypeptides/polynucleotides and according to the methods of this invention, for example, as part of the screening methods of this invention, Some of these conditions include, but are not limited to ductal hyperplasia without atypia, atypical hyperplasia, and others.

In some embodiments, the polypeptides/polynucleotides of this invention serve as markers for breast cancer, including, but not limited to: HSFLT, AA336074, Z25299 or homologues thereof. In some embodiments, the HSFLT, AA336074, Z25299 or polynucleotides encoding the same, can be used alone or in combination with any other desired marker, including, inter alia, Calcitonin, CA15-3 (Mucin1), CA27-29, TPA, a combination of CA 15-3 and CEA, CA 27.29 (monoclonal antibody directed against MUC1), Estrogen 2 (beta), HER-2 (c-erbB2), or any combinations thereof.

In some embodiments, the polypeptides/polynucleotides of this invention may be useful in, inter alia, assessing the presence, risk and/or extent of the following:
1. The identification of a metastasis of unknown origin which originated from a primary breast cancer tumor.

2. In the assessment of lymphadenopathy, and in particular axillary lymphadenopathy.
3. As a marker to distinguish between different types of breast cancer, therefore potentially affect treatment choice (e.g. as HER-2)
4. As a tool in the assessment of palpable breast mass and in particular in the differential diagnosis between a benign and malignant breast mass.
5. As a tool in the assessment of conditions affecting breast skin (e.g. Paget's disease) and their differentiation from breast cancer.
6. As a tool in the assessment of breast pain or discomfort resulting from either breast cancer or other possible conditions (e.g. Mastitis, Mondors syndrome).
7. Other conditions not mentioned above which have similar symptoms, signs and complications as breast cancer and where the differential diagnosis between them and breast cancer is of clinical importance including but not limited to:
    a. Abnormal mammogram and/or nipple retraction and/or nipple discharge due to causes other than breast cancer. Such causes include but are not limited to benign breast masses, melanoma, trauma and technical and/or anatomical variations.
    b. Any condition suggestive of a malignant tumor including but not limited to anorexia, cachexia, weight loss, fever, hypercalcemia, paraneoplastic syndrome.
   Lymphadenopathy, weight loss and other signs and symptoms associated with breast cancer but originate from diseases different from breast cancer including but not limited to other malignancies, infections and autoimmune diseases.
8. Prediction of patient's drug response
9. As surrogate markers for clinical outcome of a treated cancer.

Lung Cancer

Lung cancer is the primary cause of cancer death among both men and women in the U. S. In one embodiment, the polypeptides and/or polynucleotides of this invention are utilized alone, or in combination with other markers, for the diagnosis, treatment or assessment of prognosis of lung cancer. In one embodiment, the term "lung cancer" is to be understood as encompassing small cell or non-small cell lung cancers, including adenocarcinomas, bronchoalveolar-alveolar, squamous cell and large cell carcinomas.

In some embodiments, the polypeptides/polynucleotides of this invention are utilized in conjunction with other screening procedures, as well as the use of other markers, for the diagnosis, or assessment of prognosis of lung cancer in a subject. In some embodiments, such screening procedures may comprise the use of chest x-rays, analysis of the type of cells contained in sputum, fiberoptic examination of the bronchial passages, or any combination thereof. Such evaluation in turn may impact the type of treatment regimen pursued, which in turn may reflect the type and stage of the cancer, and include surgery, radiation therapy and/or chemotherapy.

Current radiotherapeutic agents, chemotherapeutic agents and biological toxins are potent cytotoxins, yet do not discriminate between normal and malignant cells, producing adverse effects and dose-limiting toxicities. In some embodiments of this invention, the polypeptides/polynucleotides provide a means for more specific targeting to neoplastic versus normal cells.

In some embodiments, the polypeptides for use in the diagnosis, treatment and/or assessment of progression of lung cancer may comprise: HSFLT, HSI1RA, HSPLGF, HUMSP18A, F05068, Z25299, AA336074 or homologoues thereof, or polynucleotides encoding the same. In some embodiments, these polypeptides/polynucleotides may be used alone or in combination with one or more other appropriate markers, including, inter alia, other polypeptides/polynucleotides of this invention. In some embodiments, such use may be in combination with other known markers for lung cancer, including but not limited to CEA, CA15-3, Beta-2-microglobulin, CA19-9, TPA, and/or in combination with native sequences associated with the polypeptides/polynucleotides of this invention, as herein described.

In some embodiments, the polypeptides/polynucleotides of this invention may be useful in, inter alia, assessing the presence, risk and/or extent of the following:
1. The identification of a metastasis of unknown origin which originated from a primary lung cancer.
2. The assessment of a malignant tissue residing in the lung that is from a non-lung origin, including but not limited to: osteogenic and soft tissue sarcomas; colorectal, uterine, cervix and corpus tumors; head and neck, breast, testis and salivary gland cancers; melanoma; and bladder and kidney tumors.
3. Distinguishing between different types of lung cancer, therefore potentially affect treatment choice (e.g. small cell vs. non small cell tumors).
4. Unexplained dyspnea and/or chronic cough and/or hemoptysis, and analysis thereof.
5. Differential diagnosis of the origin of a pleural effusion.
6. Conditions which have similar symptoms, signs and complications as lung cancer and where the differential diagnosis between them and lung cancer is of clinical importance including but not limited to:
    a. Non-malignant causes of lung symptoms and signs. Symptoms and signs include, but are not limited to: lung lesions and infiltrates, wheeze, stridor.
    b. Other symptoms, signs and complications suggestive of lung cancer, such as tracheal obstruction, esophageal compression, dysphagia, recurrent laryngeal nerve paralysis, hoarseness, phrenic nerve paralysis with elevation of the hemidiaphragm and Horner syndrome.
    c. Any condition suggestive of a malignant tumor including but not limited to anorexia, cachexia, weight loss, fever, hypercalcemia, hypophosphatemia, hyponatremia, syndrome of inappropriate secretion of antidiuretic hormone, elevated ANP, elevated ACTH, hypokalemia, clubbing, neurologic-myopathic syndromes and thrombophlebitis.
7. Prediction of patient's drug response
8. As surrogate markers for clinical outcome of a treated cancer.

Colorectal Cancer:

Colon and rectal cancers are malignant conditions which occur in the corresponding segments of the large intestine. In one embodiment, the polypeptides and/or polynucleotides of this invention are utilized alone, or in combination with other markers, for the diagnosis, treatment or assessment of prognosis of colorectal cancer. In some embodiments, the term "colorectal cancers" is to be understood as encompassing adenocarcinomas, carcinoid tumors, for example, found in the appendix and rectum; gastrointestinal stromal tumors for example, found in connective tissue in the wall of the colon and rectum; and lymphomas, which are malignancies of immune cells in the colon, rectum and lymph nodes. In some embodiments, the polypeptides/polynucleotides are useful in diagnosing, treating and/or assessing progression of colorectal pathogenesis, including the maturation of adenomatous polyps, to larger polyps, and all relevant stages in the neoplastic transformation of the tissue.

In some embodiments, the polypeptides/polynucleotides of this invention are utilized in conjunction with other screening procedures, as well as the use of other markers, for the diagnosis, or assessment of prognosis of colorectal cancer in a subject. In some embodiments, such screening procedures may comprise fecal occult blood tests, sigmoidoscopy, barium enema X-ray, digital rectal exam, colonoscopy, detection of carcinoembryonic antigen (CEA) or combinations thereof.

In some embodiments, the polypeptides/polynucleotides are useful in assessing progression of colorectal pathogenesis. Such assessment may reflect the staging of the colorectal cancer. In some embodiments, the polypeptides/polynucleotides are useful in assessing or altering stage progression in a subject with colorectal cancer. When in reference to cancer staging, it is to be understood that any known means or classification system will apply, for any embodiment as described herein. In some embodiments, staging in reference to colorectal cancer may be via the Dukes' system and/or the International Union against Cancer-American Joint Committee on Cancer TNM staging system. Staging will reflect, in some embodiments, the extent of tumor penetration into the colon wall, with greater penetration generally correlating with a more dangerous tumor; the extent of invasion of the tumor through the colon wall and into other neighboring tissues, with greater invasion generally correlating with a more dangerous tumor; the extent of invasion of the tumor into the regional lymph nodes, and the extent of metastatic invasion into more distant tissues, such as the liver. It is to be understood that the polypeptides/polynucleotides of this invention may be useful both in the identification/assessment of colorectal cancer pathogenesis as a function of stage designation, as well as In some embodiments, the polypeptides/polynucleotides of this invention may be useful in the diagnosis, treatment and/or assessment of prognosis of colon cancer. According to this aspect and in one embodiment, the polypeptides useful in this context are: HSFLT, HSPLGF, Z25299 or homologues thereof, or polynucleotides encoding the same. In some embodiments, these polypeptides/polynucleotides are used alone or in combination with one or more other polypeptides/polynucleotides of this invention, and/or in combination with other markers for colorectal cancer, including but not limited to CEA, CA19-9, CA50, and/or in combination with a native protein associated with the polypeptides of this invention, for example, native proteins of which the polypeptides are variants thereof. In some embodiments, the polypeptides/polynucleotides of this invention may be useful in, inter alia, assessing the presence, risk and/or extent of the following:

1. Early diagnosis, staging, grading, prognosis, monitoring, and treatment of diseases associated with colon cancer, or to indicate a predisposition to such for preventative measures.
2. The identification of a metastasis of unknown origin which originated from a primary colorectal cancer tumor, in particular when the metastasis is located in the liver, lung, bones, supraclavicluar lymph nodes or brain.
3. In the assessment of lymphadenopathy, in particular supraclavicluar or internal abdominal lymphadenopathy.
4. As a marker to distinguish between different types of colorectal tumors including but not limited to nonhereditary carcinoma, Familial Polyposis Coli, Hereditary nonpolyposis colon cancer (Lynch syndrome) and Carcinoid; therefore potentially affect treatment choice.
5. In the assessment of cancer staging, in addition and as a complementary measure to the Dukes system for staging colorectal cancer.
6. As a risk factor to the development of colorectal tumor, and in particular in diseases known to have high incidence of colorectal tumor, including but not limited to Crohn's disease and Ulcerative Colitis.
7. As a tool in the assessment of fecal occult blood or imaging findings suspected for colorectal tumor or abnormal blood tests associated with colorectal cancer including but not limited to elevated CEA level.
8. In the differential diagnosis between malignant and benign colorectal tumors, in particular adenomas and polyps.
9. Other conditions not mentioned above which have similar symptoms, signs and complications as colorectal cancer and where the differential diagnosis between them and colorectal cancer is of clinical importance including but not limited to:
   a. Any condition suggestive of a malignant tumor including but not limited to anorexia, cachexia, weight loss, fever, hypercalcemia, paraneoplastic syndrome.
   b. Lymphadenopathy, weight loss and other signs and symptoms associated with colorectal cancer but originate from diseases different from colorectal cancer including but not limited to other malignancies, infections and autoimmune diseases.
10. Prediction of patient's drug response
11. As surrogate markers for clinical outcome of a treated cancer.

Prostate Cancer

Prostate cancer is the most commonly diagnosed malignancy and the second most frequent cause of cancer-related deaths in the western male population. In one embodiment, the polypeptides and/or polynucleotides of this invention are utilized alone, or in combination with other markers, for the diagnosis, treatment or assessment of prognosis of prostate cancer.

In some embodiments, the polypeptides/polynucleotides of this invention are utilized in conjunction with other screening procedures, as well as the use of other markers, for the diagnosis, or assessment of prognosis of colorectal cancer in a subject. In some embodiments, such markers may comprise prostatic acid phosphatase (PAP), prostate-specific antigen (PSA), prostate-specific membrane antigen (PSM), PCA3 DD3 or combinations thereof.

In some embodiments, the polypeptides/polynucleotides of this invention may be useful in the diagnosis, treatment and/or assessment of prognosis of prostate cancer. According to this aspect and in one embodiment, the polypeptides useful in this context are: AA336074, Z22012, HUMTREFAC, homologues thereof, or polynucleotides encoding the same. In some embodiments, these polypeptides/polynucleotides are used alone or in combination with one or more other polypeptides/polynucleotides of this invention, and/or in combination with other markers, including, inter alia, PSA, PAP (prostatic acid phosphatase), CPK-BB, PSMA, PCA3, DD3, and/or a native protein associated with the polypeptides of this invention, for example, native proteins of which the polypeptides are variants thereof. In some embodiments the polypeptides/polynucleotides of this invention are useful in the diagnosis of prostate cancer, which includes, inter alia, the differential diagnosis between prostate cancer and BPH, prostatitis and/or prostatism.

Candidate Markers

The markers of the present invention were tested with regard to their expression in various tissue samples. Unless otherwise noted, all experimental data relates to variants of the present invention, named according to the segment being tested (as expression was tested through RT-PCR as described). A description of the samples used in the ovarian cancer testing panel is provided in Table 1 below. A description of the samples used in the colon cancer testing panel is provided in Table 2 below. A description of the samples used in the lung cancer testing panel is provided in Table 3 below. A description of the samples used in the breast cancer testing panel is provided in Table 4 and Table 4_1 below. Table 4_2 provides a key for various terms listed in table 4_1. A description of the samples used in the normal tissue panel is provided in Table 5 and table 5_1 below.

TABLE 1

Tissue samples in ovarian cancer testing panel:

| Sample name | Lot number | Source | Pathology | Grade | age |
|---|---|---|---|---|---|
| 33-B-Pap Sero CystAde G1 | A503175 | BioChain | Serous papillary cystadenocarcinoma | 1 | 41 |
| 41-G-Mix Sero/Muc/Endo G2 | 98-03-G803 | GOG | Mixed epithelial cystadenocarcinoma with mucinous, endometrioid, squamous and papillary serous (Stage2) | 2 | 38 |
| 35-G-Endo Adeno G2 | 94-08-7604 | GOG | Endometrioid adenocarcinoma | 2 | 39 |
| 14-B-Adeno G2 | A501111 | BioChain | Adenocarcinoma | 2 | 41 |
| 12-B-Adeno G3 | A406023 | Biochain | Adenocarcinoma | 3 | 45 |
| 40-G-Mix Sero/Endo G2 | 95-11-G006 | GOG | Papillary serous and endometrioid cystadenocarcinoma (Stage3C) | 2 | 49 |
| 4-A-Pap CystAdeno G2 | ILS-7286 | ABS | Papillary cystadenocarcinoma | 2 | 50 |
| 3-A-Pap Adeno G2 | ILS-1431 | ABS | Papillary adenocarcinoma | 2 | 52 |
| 2-A-Pap Adeno G2 | ILS-1408 | ABS | Papillary adenocarcinoma | 2 | 53 |
| 5-G-Adeno G3 | 99-12-G432 | GOG | Adenocarcinoma (Stage3C) | 3 | 46 |
| 11-B-Adeno G3 | A407068 | Biochain | Adenocarcinoma | 3 | 49 |
| 39--G-Mix Sero/Endo G3 | 2001-12-G037 | GOG | Mixed serous and endometrioid adenocarcinoma | 3 | 49 |
| 29-G-Sero Adeno G3 | 2001-12-G035 | GOG | Serous adenocarcinoma (Stage3A) | 3 | 50 |
| 70-G-Pap Sero Adeno G3 | 95-08-G069 | GOG | Papillary serous adenocarcinoma | 3 | 50 |
| 6-A-Adeno G3 | A0106 | ABS | adenocarcinoma | 3 | 51 |
| 31-B-Pap Sero CystAde G3 | A503176 | BioChain | Serous papillary cystadenocarcinoma | 3 | 52 |
| 25-A-Pap Sero Adeno G3 | N0021 | ABS | Papillary serous adenocarcinoma (StageT3CN1MX) | 3 | 55 |
| 37-G-Mix Sero/Endo G3 | 2002-05-G513 | GOG | Mixed serous and endometrioid adenocarcinoma | 3 | 56 |
| 7-A-Adeno G3 | IND-00375 | ABS | adenocarcinoma | 3 | 59 |
| 8-B-Adeno G3 | A501113 | BioChain | adenocarcinoma | 3 | 60 |
| 10-B-Adeno G3 | A407069 | Biochain | Adenocarcinoma | 3 | 60 |
| 38-G-Mix Sero/Endo G3 | 2002-05-G509 | GOG | Mixed serous and endometrioid adenocarcinoma of mullerian (Stage3C) | 3 | 64 |
| 13-G-Adeno G3 | 94-05-7603 | GOG | Poorly differentiated adenocarcinoma from primary peritoneal | 3 | 67 |
| 24-G- Pap Sero Adeno G3 | 2001-07-G801 | GOG | Papillary serous adenocarcinoma | 3 | 68 |
| 34-G-Pap Endo Adeno G3 | 95-04-2002 | GOG | Papillary endometrioid adenocarcinoma (Stage3C) | 3 | 68 |
| 30-G-Pap Sero Adeno G3 | 2001-08-G011 | GOG | Papillary serous carcinoma (Stage1C) | 3 | 72 |
| 1-A-Pap Adeno G3 | ILS-1406 | ABS | Papillary adenocarcinoma | 3 | 73 |
| 9-G-Adeno G3 | 99-06-G901 | GOG | Adenocarcinoma (maybe serous) | 3 | 84 |
| 32-G-Pap Sero CystAde G3 | 93-09-4901 | GOG | Serous papillary cystadenocarcinoma | 3 | 67 |
| 66-G-Pap Sero Adeno G3 SIV | 2000-01-G413 | GOG | Papillary serous carcinoma (metastasis of primary peritoneum) (Stage4) | 3 | 67 |
| 19-B-Muc Adeno G3 | A504085 | BioChain | Mucinous adenocarcinoma | 3 | 34 |
| 21-G-Muc CystAde G2-3 | 95-10-G020 | GOG | Mucinous cystadenocarcinoma (Stage2) | 2-3 | 44 |
| 18-B-Muc Adeno G3 | A504083 | BioChain | Mucinous adenocarcinoma | 3 | 45 |
| 20-A-Pap Muc CystAde | USA-00273 | ABS | Papillary mucinous cystadenocarcinoma | | 46 |
| 17-B-Muc Adeno G3 | A504084 | BioChain | Mucinous adenocarcinoma | 3 | 51 |
| 22-A-Muc CystAde G2 | A0139 | ABS | Mucinous cystadenocarcinoma (Stage1C) | 2 | 72 |
| 43-G-Clear cell Adeno G3 | 2001-10-G002 | GOG | Clear cell adenocarcinoma | 3 | 74 |
| 44-G-Clear cell Adeno | 2001-07-G084 | GOG | Clear cell adenocarcinoma (Stage3A) | | 73 |
| 15-B-Adeno G3 | A407065 | BioChain | Carcinoma | 3 | 27 |
| 16-Ct-Adeno | 1090387 | Clontech | Carcinoma NOS | NA | 58 |
| 23-A-Muc CystAde G3 | VNM-00187 | ABS | Mucinous cystadenocarcinoma with low malignant | 3 | 45 |
| 42-G-Adeno borderline | 98-08-G001 | GOG | Epithelial adenocarcinoma of borderline malignancy | | 46 |
| 63-G-Sero CysAdenoFibroma | 2000-10-G620 | GOG | Serous CysAdenoFibroma of borderline malignancy | | 71 |
| 62-G-Ben Muc CysAdenoma | 99-10-G442 | GOG | Benbin mucinus cysadenoma | | 32 |
| 60-G- Muc CysAdenoma | 99-01-G043 | GOG | Mucinous Cysadenoma | | 40 |
| 56-G-Ben Muc CysAdeno | 99-01-G407 | GOG | Bengin mucinus cysadenoma | | 46 |
| 64-G-Ben Sero CysAdenoma | 99-06-G039 | GOG | Bengin Serous CysAdenoma | | 57 |
| 61-G- Muc CysAdenoma | 99-07-G011 | GOG | Mucinous Cysadenoma | | 63 |
| 59-G-Sero CysAdenoFibroma | 98-12-G401 | GOG | Serous CysAdenoFibroma | | 77 |
| 51-G-N M41 | 98-03-G803N | GOG | Normal (matched tumor 98-03-G803) | | 38 |
| 75-G-N M60 | 99-01-G043N | GOG | Normal (matched tumor 99-01-G043) | | 40 |
| 49-B-N M14 | A501112 | BioChain | Normal (matched tumor A501111) | | 41 |
| 52-G-N M42 | 98-08-G001N | GOG | Normal (matched tumor 98-08-G001) | | 46 |
| 68-G-N M56 | 99-01-G407N | GOG | Normal (matched bengin 99-01-G407) | | 46 |
| 50-B-N M8 | A501114 | BioChain | Normal (matched tumor A501113) | | 60 |
| 67-G-N M38 | 2002-05-509N | GOG | Normal (matched tumor 2002-05-G509) | | 64 |
| 69-G-N M24 | 2001-07-G801N | GOG | Normal (matched tumor 2001-07-G801) | | 68 |
| 73-G-N M59 | 98-12-G401N | GOG | Normal (matched tumor 98-12-G401) | | 77 |
| 72-G-N M66 | 2000-01-G413N | GOG | Normal (matched tumor 2000-01-G413) | | |
| 45-B-N | A503274 | BioChain | Normal PM | | 41 |
| 46-B-N | A504086 | BioChain | Normal PM | | 41 |
| 71-CG-N | CG-188-7 | Ichilov | Normal PM | | 49 |
| 48-B-N | A504087 | BioChain | Normal PM | | 51 |

TABLE 2

Tissue samples in colon cancer testing panel

| sample name | Lot No. | tissue | source | pathology | Grade | gender/age |
|---|---|---|---|---|---|---|
| 58-B-Adeno G1 | A609152 | Colon | biochain | Adenocarcinoma | 1 | M/73 |
| 59-B-Adeno G1 | A609059 | Colon | biochain | Adenocarcinoma, Ulcer | 1 | M/58 |
| 14-CG-Polypoid Adeno G1 D-C | CG-222 (2) | Rectum | Ichilov | Well polypoid adeocarcinoma Duke's C | | F/49 |
| 17-CG-Adeno G1-2 | CG-163 | Rectum | Ichilov | Adenocarcinoma | 2 | M/73 |
| 10-CG-Adeno G1-2 D-B2 | CG-311 | Sigmod colon | Ichilov | Adenocarcinoma Astler-Coller B2. | 1-2 | M/88 |
| 11-CG-Adeno G1-2 D-C2 | CG-337 | Colon | Ichilov | Adenocarcinoma Astler-Coller C2. | 1-2 | NA |
| 6-CG-Adeno G1-2 D-C2 | CG-303 (3) | Colon | Ichilov | Adenocarcinoma Astler-Coller C2. | 1-2 | F/77 |
| 5-CG-Adeno G2 | CG-308 | Colon Sigma | Ichilov | Adenocarcinoma. | 2 | F/80 |
| 16-CG-Adeno G2 | CG-278C | colon | Ichilov | Adenocarcinoma | 2 | F/60 |
| 56-B-Adeno G2 | A609148 | Colon | biochain | Adenocarcinoma | 2 | F48 |
| 61-B-Adeno G2 | A606258 | Colon | biochain | Adenocarcinoma, Ulcer | 2 | M/41 |
| 60-B-Adeno G2 | A609058 | Colon | biochain | Adenocarcinoma, Ulcer | 2 | M/67 |
| 22-CG-Adeno G2 D-B | CG-229C | Colon | Ichilov | Adenocarcinoma Duke's B | 2 | F/55 |
| 1-CG-Adeno G2 D-B2 | CG-335 | Cecum | Ichilov | Adenocarcinoma Dukes B2. | 2 | F/66 |
| 12-CG-Adeno G2 D-B2 | CG-340 | Colon Sigma | Ichilov | Adenocarcinoma Astler-Coller B2. | 2 | M/66 |
| 28-CG-Adeno G2 D-B2 | CG-284 | sigma | Ichilov | Adenocarcinoma Duke's B2 | 2 | F/72 |
| 2-CG-Adeno G2 D-C2 | CG-307 X2 | Cecum | Ichilov | Adenocarcinoma Astler-Coller C2. | 2 | F/89 |
| 9-CG-Adeno G2 D-D | CG-297 X2 | Rectum | Ichilov | Adenocarcinoma Dukes D. | 2 | M/62 |
| 13-CG-Adeno G2 D-D | CG-290 X2 | Rectosigmoidal colon | Ichilov | Adenocarcinoma Dukes D. | 2 | M/47 |
| 26-CG-Adeno G2 D-D | CG-283 | sigma | Ichilov | Colonic adenocarcinoma Duke's D | 2 | F/63 |
| 4-CG-Adeno G3 | CG-276 | Colon | Ichilov | Carcinoma. | 3 | M/64 |
| 53-B-Adeno G3 | A609161 | Colon | biochain | Adenocarcinoma | 3 | F/53 |
| 54-B-Adeno G3 | A609142 | Colon | biochain | Adenocarcinoma | 3 | M/53 |
| 55-B-Adeno G3 | A609144 | Colon | biochain | Adenocarcinoma | 3 | M/68 |
| 57-B-Adeno G3 | A609150 | Colon | biochain | Adenocarcinoma | 3 | F/45 |
| 72-CG-Adeno G3 | CG-309 | colon | Ichilov | Adenocarcinoma | 3 | F/88 |
| 20-CG-Adeno G3 D-B2 | CG-249 | Colon | Ichilov | Ulcerated adenocarcinoma Duke's B2 | 3 | M/36 |
| 7-CG-Adeno D-A | CG-235 | Rectum | Ichilov | Adenocarcinoma intramucosal Duke's A. | | F/66 |
| 23-CG-Adeno D-C | CG-282 | sigma | Ichilov | Mucinus adenocarcinoma Astler Coller C | | M/51 |
| 3-CG-Muc adeno D-D | CG-224 | Colon | Ichilov | Mucinois adenocarcinoma Duke's D | | M/48 |
| 18-CG-Adeno | CG-22C | Colon | Ichilov | Adenocarcinoma | | NA |
| 19-CG-Adeno | CG-19C (1) | Colon | Ichilov | Adenocarcinoma | | NA |
| 21-CG-Adeno | CG-18C | Colon | Ichilov | Adenocarcinoma | | NA |
| 24-CG-Adeno | CG-12 (2) | Colon | Ichilov | Adenocarcinoma | | NA |
| 25-CG-Adeno | CG-2 | Colon | Ichilov | Adenocarcinoma | | NA |
| 27-CG-Adeno | CG-4 | Colon | Ichilov | Adenocarcinoma | | NA |
| 8-CG-diverticolosis, diverticulitis | CG-291 | Wall of sigma | Ichilov | Diverticolosis and diverticulitis of the Colon | | F/65 |
| 46-CG-Crohn's disease | CG-338C | Cecum | Ichilov | Crohn's disease | | M/22 |
| 47-CG-Crohn's disease | CG-338AC | Colon | Ichilov | Crohn's disease. | | M/22 |
| 42-CG-N M20 | CG-249N | Colon | Ichilov | Normal | | M/36 |
| 43-CG-N M8 | CG-291N | Wall of sigma | Ichilov | Normal | | F/65 |
| 44-CG-N M21 | CG-18N | Colon | Ichilov | Normal | | NA |
| 45-CG-N M11 | CG-337N | Colon | Ichilov | Normal | | M/75 |
| 49-CG-N M14 | CG-222N | Rectum | Ichilov | Normal | | F/49 |
| 50-CG-N M5 | CG-308N | Sigma | Ichilov | Within normal limits | | F/80 |
| 51-CG-N M26 | CG-283N | Sigma | Ichilov | Normal | | F/63 |
| 41-B-N | A501156 | Colon | biochain | Normal PM | | M/78 |
| 52-CG-N | CG-309TR | Colon | Ichilov | Within normal limits | | F/88 |
| 62-B-N | A608273 | Colon | biochain | Normal PM | | M/66 |
| 63-B-N | A609260 | Colon | biochain | Normal PM | | M/61 |
| 64-B-N | A609261 | Colon | biochain | Normal PM | | F/68 |
| 65-B-N | A607115 | Colon | biochain | Normal PM | | M/24 |
| 66-B-N | A609262 | Colon | biochain | Normal PM | | M/58 |
| 67-B-N | A406029 | Colon | biochain | Normal PM (Pool of 10) | | |
| 69-B-N | A411078 | Colon | biochain | Normal PM (Pool of 10) | | F&M |
| 70-Cl-N | 1110101 | Colon | clontech | Normal PM (Pool of 3) | | |
| 71-Am-N | 071P10B | Colon | Ambion | Normal (IC BLEED) | | F/34 |

TABLE 3

Tissue samples in lung cancer testing panel

| sample name | Lot No. | source | pathology | Grade | gender/age |
|---|---|---|---|---|---|
| 1-B-Adeno G1 | A504117 | Biochain | Adenocarcinoma | 1 | F/29 |
| 2-B-Adeno G1 | A504118 | Biochain | Adenocarcinoma | 1 | M/64 |
| 95-B-Adeno G1 | A610063 | Biochain | Adenocarcinoma | 1 | F/54 |
| 12-B-Adeno G2 | A504119 | Biochain | Adenocarcinoma | 2 | F/74 |
| 75-B-Adeno G2 | A609217 | Biochain | Adenocarcinoma | 2 | M/65 |
| 77-B-Adeno G2 | A608301 | Biochain | Adenocarcinoma | 2 | M/44 |
| 13-B-Adeno G2-3 | A504116 | Biochain | Adenocarcinoma | 2-3 | M/64 |

TABLE 3-continued

Tissue samples in lung cancer testing panel

| sample name | Lot No. | source | pathology | Grade | gender/age |
|---|---|---|---|---|---|
| 89-B-Adeno G2-3 | A609077 | Biochain | Adenocarcinoma | 2-3 | M/62 |
| 76-B-Adeno G3 | A609218 | Biochain | Adenocarcinoma | 3 | M/57 |
| 94-B-Adeno G3 | A610118 | Biochain | Adenocarcinoma | 3 | M/68 |
| 3-CG-Adeno | CG-200 | Ichilov | Adenocarcinoma | | NA |
| 14-CG-Adeno | CG-111 | Ichilov | Adenocarcinoma | | M/68 |
| 15-CG-Bronch adeno | CG-244 | Ichilov | Bronchioloalveolar adenocarcinoma | | M/74 |
| 45-B-Alvelous Adeno | A501221 | Biochain | Alveolus carcinoma | | F/50 |
| 44-B-Alvelous Adeno G2 | A501123 | Biochain | Alveolus carcinoma | 2 | F/61 |
| 19-B-Squamous G1 | A408175 | Biochain | Squamous carcinoma | 1 | M/78 |
| 16-B-Squamous G2 | A409091 | Biochain | Squamous carcinoma | 2 | F/68 |
| 17-B-Squamous G2 | A503183 | Biochain | Squamous carcinoma | 2 | M/57 |
| 21-B-Squamous G2 | A503187 | Biochain | Squamous carcinoma | 2 | M/52 |
| 78-B-Squamous G2 | A607125 | Biochain | Squamous Cell Carcinoma | 2 | M/62 |
| 80-B-Squamous G2 | A609163 | Biochain | Squamous Cell Carcinoma | 2 | M/74 |
| 18-B-Squamous G2-3 | A503387 | Biochain | Squamous Cell Carcinoma | 2-3 | M/63 |
| 81-B-Squamous G3 | A609076 | Biochain | Squamous Carcinoma | 3 | m/53 |
| 79-B-Squamous G3 | A609018 | Biochain | Squamous Cell Carcinoma | 3 | M/67 |
| 20-B-Squamous | A501121 | Biochain | Squamous Carcinoma | | M/64 |
| 22-B-Squamous | A503386 | Biochain | Squamous Carcinoma | | M/48 |
| 88-B-Squamous | A609219 | Biochain | Squamous Cell Carcinoma | | M/64 |
| 100-B-Squamous | A409017 | Biochain | Squamous Carcinoma | | M/64 |
| 23-CG-Squamous | CG-109 (1) | Ichilov | Squamous Carcinoma | | M/65 |
| 24-CG-Squamous | CG-123 | Ichilov | Squamous Carcinoma | | M/76 |
| 25-CG-Squamous | CG-204 | Ichilov | Squamous Carcinoma | | M/72 |
| 87-B-Large cell G3 | A609165 | Biochain | Large Cell Carcinoma | 3 | F/47 |
| 38-B-Large cell | A504113 | Biochain | Large cell | | M/58 |
| 39-B-Large cell | A504114 | Biochain | Large cell | | F/35 |
| 82-B-Large cell | A609170 | Biochain | Large Cell Neuroendocrine Carcinoma | | M/68 |
| 30-B-Small cell carci G3 | A501389 | Biochain | small cell | 3 | M/34 |
| 31-B-Small cell carci G3 | A501390 | Biochain | small cell | 3 | F/59 |
| 32-B-Small cell carci G3 | A501391 | Biochain | small cell | 3 | M/30 |
| 33-B-Small cell carci G3 | A504115 | Biochain | small cell | 3 | M |
| 86-B-Small cell carci G3 | A608032 | Biochain | Small Cell Carcinoma | 3 | F/52 |
| 83-B-Small cell carci | A609162 | Biochain | Small Cell Carcinoma | | F/47 |
| 84-B-Small cell carci | A609167 | Biochain | Small Cell Carcinoma | | F/59 |
| 85-B-Small cell carci | A609169 | Biochain | Small Cell Carcinoma | | M/66 |
| 46-B-N M44 | A501124 | Biochain | Normal M44 | | F/61 |
| 47-B-N | A503205 | Biochain | Normal PM | | M/26 |
| 48-B-N | A503206 | Biochain | Normal PM | | M/44 |
| 49-B-N | A503384 | Biochain | Normal PM | | M/27 |
| 50-B-N | A503385 | Biochain | Normal PM | | M/28 |
| 90-B-N | A608152 | Biochain | Normal (Pool 2) PM | | pool 2 |
| 91-B-N | A607257 | Biochain | Normal (Pool 2) PM | | pool 2 |
| 92-B-N | A503204 | Biochain | Normal PM | | m/28 |
| 93-Am-N | 111P0103A | Ambion | Normal PM | | F/61 |
| 96-Am-N | 36853 | Ambion | Normal PM | | F/43 |
| 97-Am-N | 36854 | Ambion | Normal PM | | M/46 |
| 98-Am-N | 36855 | Ambion | Normal PM | | F/72 |
| 99-Am-N | 36856 | Ambion | Normal PM | | M/31 |

TABLE 4

Tissue samples in breast cancer testing panel

| sample name | Lot no | source | pathology | grade | age | TNM | stage |
|---|---|---|---|---|---|---|---|
| 14-A-IDC G2 | A0135T | ABS | IDC | 2 | 37 | T2N2Mx | |
| 43-B-IDC G2 | A609183 | Biochain | IDC | 2 | 40 | | |
| 54-B-IDC G2 | A605353 | Biochain | IDC | 2 | 41 | | |
| 55-B-IDC G2 | A609179 | Biochain | IDC | 2 | 42 | | |
| 47-B-IDC G2 | A609221 | Biochain | IDC | 2 | 42 | | |
| 17-A-IDC G2 | 4904020036T | ABS | IDC | 2-3 | 42 | T3N1Mx | |
| 42-B-IDC G3 | 6005020031T | ABS | IDC | 3 | 42 | T1cN0Mx | |
| 7-A-IDC G2 | 7263T | ABS | IDC | 2 | 43 | T1N0M0 | stage 1 |
| 48-B-IDC G2 | A609222 | Biochain | IDC | 2 | 44 | | |
| 53-B-IDC G2 | A605151 | Biochain | IDC | 2 | 44 | | |
| 12-A-IDC G2 | 1432T | ABS | IDC | 2 | 46 | T2N0M0 | stage 2A |
| 61-B-IDC G2 | A610029 | Biochain | IDC | 2 | 46 | | |
| 46-B-Carci G2 | A609177 | Biochain | Carcinoma | 2 | 48 | | |
| 16-A-IDC G2 | 4904020032T | ABS | IDC | 2 | 49 | T3N1Mx | |
| 62-B-IDC G2 | A609194 | Biochain | IDC | 2 | 51 | | |
| 49-B-IDC G2 | A609223 | Biochain | IDC | 2 | 54 | | |

TABLE 4-continued

Tissue samples in breast cancer testing panel

| sample name | Lot no | source | pathology | grade | age | TNM | stage |
|---|---|---|---|---|---|---|---|
| 32-A-Muc Carci | 7116T | ABS | Mucinous carcinoma | | 54 | T2N0M0 | stage 2A |
| 45-B-IDC G2 | A609181 | Biochain | IDC | 2 | 58 | | |
| 15-A-IDC G2 | 7259T | ABS | IDC | 2 | 59 | T3N1M0 | stage 3A |
| 52-B-ILC G1 | A605360 | Biochain | Invasive Lobular Carcinoma | 1 | 60 | | |
| 6-A-IDC G1 | 7238T | ABS | IDC | 1 | 60 | T2N0M0 | stage 2A |
| 26-A-IDC G3 | 7249T | ABS | IDC | 3 | 60 | T2N0M0 | stage 2A |
| 13-A-IDC G2 | A0133T | ABS | IDC | 2 | 63 | T2N1aMx | |
| 50-B-IDC G2 | A609224 | Biochain | IDC | 2 | 69 | | |
| 44-B-IDC G2 | A609198 | Biochain | IDC | 2 | 77 | | |
| 51-B-IDC G1 | A605361 | Biochain | IDC | 1 | 79 | | |
| 31-CG-IDC | CG-154 | Ichilov | IDC | | 83 | | |
| 27-A-IDC G3 | 4907020072T | ABS | IDC | 3 | 91 | T2N0Mx | |
| 36-A-N M7 | 7263N | ABS | Normal matched to 7T | | 43 | | |
| 40-A-N M12 | 1432N | ABS | Normal matched to 12T | | 46 | | |
| 39-A-N M15 | 7259N | ABS | Normal matched to 15T | | 59 | | |
| 35-A-N M6 | 7238N | ABS | Normal matched to 6T | | 60 | | |
| 41-A-N M26 | 7249N | ABS | Normal matched to 26T | | 60 | | |
| 57-B-N | A609233 | Biochain | Normal PM | | 34 | | |
| 59-B-N | A607155 | Biochain | Normal PM | | 35 | | |
| 60-B-N | A609234 | Biochain | Normal PM | | 36 | | |
| 63-Am-N | 26486 | Ambion | Normal PS | | 43 | | |
| 66-Am-N | 36678 | Ambion | Normal PM | | 45 | | |
| 64-Am-N | 23036 | Ambion | Normal PM | | 57 | | |
| 56-B-N | A609235 | Biochain | Normal PM | | 59 | | |
| 65-Am-N | 31410 | Ambion | Normal PM | | 63 | | |
| 67-Am-N | 073P010602086A | Ambion | Normal PM | | 64 | | |
| 58-B-N | A609232 | Biochain | Normal PM | | 65 | | |

TABLE 4_1

Tissue samples in Breast cancer testing panel

| Tissue | Source/ Delivery | sample name | sample_id (GCI)/ case id (Asterand)/ old no. (old samples) | TISSUE_ID (GCI)/ specimen ID (Asterand) | SampleID (Asterand) | SampD LAG | Grade | TNM | C Stage | Tum % | age | MS | WT (KG) | HT (CM) | BMI | Ethnic B | # of Preg. | # Live Bir | Age of first child | Br child | Recovery Type | Year of birth |
|---|---|---|---|---|---|---|---|---|---|---|---|---|---|---|---|---|---|---|---|---|---|---|
| BC_in-situ | Aster | 1-As-DCIS S0 | 19723 | 42509 | 42509A1 | DCIS | High Grade | T1aN0M0 | 0 | 100 | 39 | Pre-M | 102 | 157 | 41.4 | CAU | 2 | 1 | | | Surg | |
| BC | GCI | 2-GC-IDC SI | 5IRTK | 5IRTKAXT | | IDC | | | I | 75 | 39 | Pre-M | 48.1 | 147 | 22.2 | WCAU | 1 | 0 | | . | Surg | 1962 |
| BC | ABS | 3-(42)-AB-IDC SI | 600502003lT | | | IDC | 3 | T1cN0Mx | I | | 42 | | | | | | | | | | | |
| BC | ABS | 4-(7)-AB-IDC SI | 7263T | | | IDC | 2 | T1N0M0 | I | | 43 | | | | | | | | | | | |
| BC | GCI | 5-GC-IDC SI | DSI52 | DSI52AH3 | | IDC | | | I | 50 | 50 | Post-M | 113.4 | 175 | 36.9 | WCAU | 2 | 2 | 17 | 0 | Surg | 1951 |
| BC | GCI | 6-GC-IDC SI | S2GBY | S2GBYAGC | | IDC | | | I | 55 | 56 | Post-M | 57.6 | 168 | 20.5 | WCAU | 0 | . | . | . | Surg | 1945 |
| BC | GCI | 7-GC-IDC SI | POPHP | POPHPAZ4 | | IDC | | | I | 65 | 57 | Post-M | 76.2 | 165 | 28.0 | WCAU | 2 | 2 | 17 | 0 | Surg | 1944 |
| BC | GCI | 8-GC-IDC SI | I2YLE | I2YLEACP | | IDC | | | I | 65 | 60 | Post-M | 68 | 140 | 34.8 | WCAU | 1 | 1 | 23 | 0 | Surg | 1942 |
| BC | Aster | 9-As-IDC SI | 17959 | 31225 | 31225A1 | IDC | 2 | T1NXM0 | I | 90 | 65 | Post-M | 70 | 168 | 24.8 | CAU | 3 | 2 | | | Aut | |
| BC | ABS | 10-(12)-AB-IDC SIIA | 1432T | | | IDC | 2 | T2N0M0 | IIA | | 46 | | | | | | | | | | | |
| BC | Aster | 11-As-IDC SIIA | 17138 | 30697 | 30697A1 | IDC | 3 | T2NXM0 | IIA | 90 | 46 | Pre-M | 69 | 174 | 22.8 | CAU | 1 | 1 | | | Surg | |
| BC | GCI | 12-GC-IDC SIIA | YSZ67 | YSZ67A48 | | IDC | | | IIA | 70 | 46 | Pre-M | 76.2 | 165 | 28.0 | WCAU | 1 | 0 | 0 | 0 | Surg | 1956 |
| BC | ABS | 13-(6)-AB-IDC SIIA | 7238T | | | IDC | 1 | T2N0M0 | IIA | | 60 | | | | | | | | | | | |
| BC | ABS | 14-(26)-AB-IDC SIIA | 7249T | | | IDC | 3 | T2N0M0 | IIA | | 60 | | | | | | | | | | | |
| BC | GCI | 15-GC-IDC SIIA | UT3SE | UT3SEAQY | | IDC | | | IIA | 80 | 67 | Post-M | 113.4 | 168 | 40.4 | WCAU | 3 | 1 | 34 | 0 | Surg | 1938 |
| BC | GCI | 16-GC-IDC SIIA | PVSYX | PVSYXA72 | | IDC | | | IIA | 65 | 70 | Pre-M | 79.4 | 163 | 30.0 | WCAU | 2 | 2 | 20 | 0 | Surg | 1932 |
| BC | GCI | 17-GC-IDC SIIA | GETCV | GETCVAY2 | | IDC | | | IIA | 55 | 70 | Post-M | 72.6 | 163 | 27.5 | WCAU | 2 | 2 | 21 | 0 | Surg | 1931 |
| BC | ABS | 18-(27)-AB-IDC SIIA | 4907020072T | | | IDC | 3 | T2N0Mx | IIA | | 91 | | | | | | | | | | | |
| BC | GCI | 19-GC-IDC SIIB | SE5BK | SE5BKAEQ | | IDC | | | IIB | 55 | 41 | Pre-M | 61.2 | 165 | 22.5 | WCAU | 0 | . | . | . | Surg | 1960 |
| BC | GCI | 20-GC-IDC SIIB | OLKL4 | OLKL4AO6 | | IDC | | | IIB | 60 | 46 | Pre-M | 111.1 | 168 | 39.5 | WCAU | 2 | 2 | 24 | 2 | Surg | 1955 |

TABLE 4_1-continued

Tissue samples in Breast cancer testing panel

| Tissue | Source/ Delivery | sample name | sample_id (GCI)/ case id (Asterand)/ lot no. (old samples) | TISSUE_ID (GCI)/ specimen ID (Asterand) | SampleID (Asterand) | SampD IAG | Grade | TNM | C Stage | Tum % | age | MS | WT (KG) | HT (CM) | BMI | Ethnic B | # of Preg. | # Live Bir | Age of first child | Br child | Recovery Type | Year of birth |
|---|---|---|---|---|---|---|---|---|---|---|---|---|---|---|---|---|---|---|---|---|---|---|
| BC | GCI | 21-GC-IDC SIIB | VK1EJ | VK1EJAQE | | IDC | | | IIB | 60 | 54 | Post-M | 72.6 | 168 | 25.8 | WCAU B | 0 | . | . | . | Surg | 1947 |
| BC | GCI | 22-GC-IDC SIIB | 3Z5Z4 | 3Z5Z4ANH | | IDC | | | IIB | 85 | 60 | Post-M | 80 | 163 | 30.3 | WCAU | 1 | 1 | 22 | 0 | Surg | 1942 |
| BC | ABS | 23-(13)-AB-IDC SIIB | A0133T | | | IDC | 2 | T2N1aMx | IIB | | 63 | | | | | | | | | | | |
| BC | GCI | 24-GC-IDC SIIB | J5MPN | J5MPNA9Q | | IDC | | | IIB | 55 | 64 | Post-M | 68.5 | 157 | 27.6 | WCAU | 4 | 3 | 25 | 3 | Surg | 1938 |
| BC | GCI | 25-GC-IDC SIIB | 54NTA | 54NTAAKT | | IDC | | | IIB | 70 | 67 | Post-M | 56.7 | 160 | 22.1 | WCAU | 5 | 5 | 20 | 0 | Surg | 1934 |
| BC | GCI | 27-GC-IDC SIIIA | RD3F9 | RD3F9AFQ | | IDC | | | IIIA | 90 | 41 | ? | 63.5 | 157 | 25.6 | WCAU | 1 | 1 | 25 | 0 | Surg | 1962 |
| BC | ABS | 28-(17)-AB-IDC SIIIA | 490402036T | | | IDC | 2-3 | T3N1Mx | IIIA | | 42 | | | | | | | | | | | |
| BC | ABS | 29-(16)-AB-IDC MIA | 490402032T | | | IDC | 2 | T3N1Mx | IIIA | | 49 | | | | | | | | | | | |
| BC | ABS | 30-(15)-AB-IDC SIIIA | 7259T | | | IDC | 2 | T3N1M0 | IIIA | | 59 | | | | | | | | | | | |
| BC | GCI | 31-GC-IDC SIIIA | YOLOF | YOLOFARG | | IDC | | | IIIA | 85 | 62 | Post-M | 82.6 | 160 | 32.2 | WCAU | 3 | 3 | 20 | 0 | Surg | 1943 |
| BC | GCI | 32-GC-IDC SIIIB | 4W2NY | 4W2NYAC1 | | IDC | | | IIIB | 50 | 39 | Pre-M | 54.4 | 163 | 20.6 | WCAU | 2 | 2 | 26 | 0 | Surg | 1962 |
| BC | GCI | 33-GC-IDC SIIIB | YQ1WW | YQ1WWAUV | | IDC | | | IIIB | 60 | 62 | Pre-M | 78 | 163 | 29.5 | WCAU | 0 | . | . | . | Surg | 1940 |
| BC | GCI | 34-GC-IDC SIIIB | KIOE7 | KIOE7AI9 | | IDC | | | IIIB | 55 | 65 | Post-M | 73.5 | 157 | 29.6 | WCAU | 2 | 2 | 18 | 2 | Surg | 1939 |
| BC | Bioch | 70-(43)-Bc-IDC | A609183 | | | IDC | 2 | | | | 40 | | | | | | | | | | | |
| BC | Bioch | 71-(54)-Bc-IDC | A605353 | | | IDC | 2 | | | | 41 | | | | | | | | | | | |
| BC | ABS | 72-(55)-Bc-IDC | A609179 | | | IDC | 2 | | | | 42 | | | | | | | | | | | |
| BC | Bioch | 73-(47)-Bc-IDC | A609221 | | | IDC | 2 | | | | 42 | | | | | | | | | | | |
| BC | Bioch | 74-(48)-Bc-IDC | A609222 | | | IDC | 2 | | | | 44 | | | | | | | | | | | |
| BC | Bioch | 75-(53)-Bc-IDC | A605151 | | | IDC | 2 | | | | 44 | | | | | | | | | | | |
| BC | Bioch | 76-(61)-Bc-IDC | A610029 | | | IDC | 2 | | | | 46 | | | | | | | | | | | |
| BC | Bioch | 77-(46)-Bc-Carci | A609177 | | | Carc | 2 | | | | 48 | | | | | | | | | | | |

TABLE 4_1-continued

Tissue samples in Breast cancer testing panel

| Tissue | Source/ Delivery | sample name | sample_id (GCI)/ case id (Asterand)/ old lot no. (old samples) | TISSUE_ID (GCI)/ specimen ID (Asterand) | SampleID (Asterand) | SampD IAG | Grade | TNM | C Stage | Tum % | age | MS | WT (KG) | HT (CM) | BMI | Ethnic | # of Preg. | # Live Bir | Age of first child | Br child | Recovery Type | Year of birth |
|---|---|---|---|---|---|---|---|---|---|---|---|---|---|---|---|---|---|---|---|---|---|---|
| BC | Ichilov | 78-(62)-Bc-IDC | A609194 | | | IDC | 2 | | | | 51 | | | | | | | | | | | |
| BC | Amb | 79-(32)-AB-Muc Carci SIIA | 7116T | | | MC | | T2N0M0 | IIA | | 54 | | | | | | | | | | | |
| BC | GCI | 80-(49)-Bc-IDC | A609223 | | | IDC | 2 | | | | 54 | | | | | | | | | | | |
| BC | GCI | 81-(45)-Bc-IDC | A609181 | | | IDC | 2 | | | | 58 | | | | | | | | | | | |
| BC | GCI | 82-(50)-Bc-IDC | A609224 | | | IDC | 2 | | | | 69 | | | | | | | | | | | |
| BC | Bioch | 83-(44)-Bc-IDC | A609198 | | | IDC | 2 | | | | 77 | | | | | | | | | | | |
| BC | Bioch | 84-(51)-Bc-IDC | A605361 | | | IDC | 1 | | | | 79 | | | | | | | | | | | |
| BC | Amb | 85-(31)-Ic-IDC | CG-154 | | | IDC | | | | | 83 | | | | | | | | | | | |
| BC | Aster | 35-As-ILC SI | 17090 | 30738 | 30738A1 | ILC | | T1cNXM0 | I | 100 | 50 | | 94 | 170 | 32.5 | W | | | | | | |
| BC | GCI | 36-GC-ILC SIIA | I35US | I35USA9G | | ILC | | | IIA | 60 | 70 | | 77.1 | 178 | 24.4 | WCAU | | | | | Surg | 1932 |
| BC | GCI | 37-GC-ILC SIIB | IS84Y | IS84YAAY | | ILC | | | IIB | 65 | 67 | Post-M | 62.6 | 163 | 23.7 | WCAU | | | | | Surg | 1934 |
| BC | Bioch | 38-(52)-Bc-ILC | A605360 | | | ILC | 1 | | | | 60 | | | | | | | | | | | |
| BB | Aster | 39-As-Ben | 11975 | 15478 | 15478B1 | FIBR | | | | 100 | 24 | Pre-M | 80 | 164 | 29.7 | CAU | 2 | 2 | | | Surg | 1967 |
| BB | GCI | 40-GC-Ben | ZT15M | ZT15MAMR | | FIBR | | | | 100 | 34 | | 57.6 | 165 | 21.1 | WCAU | | | | | Surg | 1948 |
| BB | GCI | 41-GC-Ben | NNP3Q | NNP3QA4V | | FIBR | | | | 95 | 54 | | 56.7 | 157 | 22.9 | WCAU | | | | | Surg | 1960 |
| BB | GCI | 42-GC-Ben | QK8IY | QK8IYALU | | FIBR | | | | 100 | 41 | | 59 | 173 | 19.7 | WCAU | | | | | Surg | 1960 |
| BN-PS | GCI | 43-GC-N PS | 83LO7 | 83LO7NEH | | NB-PS | | | | | 32 | | 78.5 | 155 | 32.7 | WCAU | | | | | Surg | 1969 |
| BN-PS | GCI | 45-GC-N PS | O6JBJ | O6JBJNT1 | | NB-PS | | | | | 38 | | 67.1 | 173 | 22.5 | WCAU | 2 | 2 | 16 | 0 | Surg | 1963 |
| BN-PS | GCI | 46-GC-N PS | E6UDD | E6UDDNCF | | NB-PS | | | | | 40 | | 99.8 | 170 | 34.5 | WCAU | 2 | . | . | . | Surg | 1961 |
| BN-PS | GCI | 47-GC-N PS | DHLR1 | DHLR1NIQ | | NB-PS | | | | | 40 | | 90.7 | 168 | 32.3 | WCAU | 2 | 2 | . | . | Surg | 1961 |
| BN-PS | GCI | 48-GC-N PS | JHQEH | JHQEHN4D | | NB-PS | | | | | 41 | | 65.3 | 157 | 26.3 | WCAU | 2 | 0 | | | Surg | 1960 |
| BN-PS | Amb | 49-(63)-Am-N PS | 26486 | | | NB-PS | | | | | 43 | | | | | | | | | | | |

TABLE 4_1-continued

Tissue samples in Breast cancer testing panel

| Tissue | Source/ Delivery | sample name | sample_id (GCI)/ case id (Asterand)/ old lot no. (old samples) | TISSUE_ID (GCI)/ specimen ID (Asterand) | SampleID (Asterand) | SampD LAG | Grade | TNM | C Stage | Tum % | age | MS | WT (KG) | HT (CM) | BMI | Ethnic B | # of Preg. | # Live Bir | Age of first child | Br child | Recovery Type | Year of birth |
|---|---|---|---|---|---|---|---|---|---|---|---|---|---|---|---|---|---|---|---|---|---|---|
| BN-PS | GCI | 50-GC-N PS | ONBFK | ONBFKNO2 | | NB-PS | | | | | 45 | | 81.6 | 165 | 30.0 | WCAU | | | | | Surg | 1956 |
| BN-PS | GCI | 51-GC-N PS | TG6J6 | TG6J6NNA | | NB-PS | | | | | 46 | | 90.7 | 173 | 30.4 | WCAU | | | | | Surg | 1955 |
| BN-PS | Aster | 52-GC-N PS | 14398 | 20021 | 20021D1 | NB-PS | | | | | 49 | Pre-M | 68 | 165 | 25.0 | CAU | 3 | | | | Surg | 1949 |
| BN-PS | GCI | 54-GC-N PS | AJGXV | AJGXVNFC | | NB-PS | | | | | 52 | | 70 | 168 | 24.8 | WCAU | | 3 | | | Surg | 1947 |
| BN-PS | GCI | 56-GC-N PS | HLCZX | HLCZXNLS | | NB-PS | | | | | 54 | | 67 | 163 | 25.2 | WCAU | | | | | Surg | |
| BN-PS | GCI | 58-GC-N PS | FGV8P | FGV8PNQ6 | | NB-PS | | | | | 61 | | 106.6 | 168 | 37.9 | WCAU | | | | | Surg | 1940 |
| BN-? | Aster | 59-As-N PS | 9264 | 9486 | 9486A1 | NB-PS | | | | | 0 | | 0 | 0 | 0.0 | | | | | | | |
| BN-PM | Bioch | 60-(57)-Bc-N PM | A609233 | A609233 | | NB-PM | | | | | 34 | | | | | | | | | | Aut | |
| BN-PM | Bioch | 61-(59)-Bc-N PM | A607155 | A607155 | | NB-PM | | | | | 35 | | | | | | | | | | Aut | |
| BN-PM | Bioch | 62-(60)-Bc-N PM | A609234 | A609234 | | NB-PM | | | | | 36 | | | | | | | | | | Aut | |
| BN-PM | Amb | 63-(66)-Am-N PM | 36678 | 36678 | | NB-PM | | | | | 45 | | | | | | | | | | Aut | |
| BN-PM | Amb | 64-(64)-Am-N PM | 23036 | 23036 | | NB-PM | | | | | 57 | | | | | | | | | | Aut | |
| BN-PM | Amb | 65-(65)-Am-N PM | 31410 | 31410 | | NB-PM | | | | | 63 | | | | | | | | | | Aut | |
| BN-PM | Amb | 66-(67)-Am-N PM | 073P010602 086A | 073P010602 086A | | NB-PM | | | | | 64 | | | | | | | | | | Aut | |
| BN-PM | Bioch | 67-(58)-Bc-N PM | A609232 | A609232 | | NB-PM | | | | | 65 | | | | | | | | | | Aut | |
| BN-PM | Aster | 68-As-N PM | 8862 | 8766 | 8766B1 | NB-PM | | | | | 74 | | 64 | 157 | 26.0 | CAU | | | | | Aut | |
| BN-PM | Aster | 69-As-N PM | 8457 | 7928 | 7928M1 | NB-PM | | | | | 87 | | 59 | 165 | 21.7 | CAU | | | | | Aut | |

TABLE 4_2

| Key | Full Name |
|---|---|
| # Live Bir | # Live Births |
| # of Preg | Number of Pregnancies |
| Amb | Ambion |
| Aster | Asterand |
| Aut | Autopsy |
| BB | Breast Benign |
| BC | Breast Cancer |
| Bioch | Biochain |
| BN | Breast Normal |
| BN-PM | Breast Normal-PM |
| BN-PS | Breast Normal-PS |
| Breastfeed child | Br Child |
| C Stage | Cancer Stage |
| Care | Carcinoma |
| CAU | Caucasian |
| DCIS | Ductal Carcinoma In Situ |
| Ethnic B | Ethnic Background |

TABLE 4_2-continued

| Key | Full Name |
|---|---|
| FIBR | FIBROADENOMA |
| IDC | INFILTRATING DUCTAL CARCINOMA |
| ILC | INFILTRATING LOBULAR CARCINOMA |
| M | Menopausal |
| MC | Mucinous carcinoma |
| MS | Menopausal Status |
| NB-PM | NORMAL BREAST-PM |
| NB-PS | NORMAL BREAST-PS |
| Post-M | Post-Menopausal |
| Pre-M | Pre-Menopausal |
| Samp DIAG | Sample Diagnosis |
| Surg | Surgical |
| Tum % | Percentage of Tumor |
| W | White |
| WCAU | White Caucasian |

TABLE 5

Tissue samples in normal panel:

| | Lot no. | Source | Tissue | Pathology | Sex/Age | comments |
|---|---|---|---|---|---|---|
| 1-Am-Colon (C71) | 071P10B | Ambion | Colon | PM IC bleed | F/43 | IC—intracarnial bleed |
| 2-B-Colon (C69) | A411078 | Biochain | Colon | PM-Pool of 10 | M (26-78)&F(53-77) | |
| 3-Cl-Colon (C70) | 1110101 | Clontech | Colon | PM-Pool of 3 sudden death | M&F (20-50) | |
| 4-Am-Small Intestine | 091P0201A | Ambion | Small Intestine | PM ICH | M/85 | |
| 5-B-Small Intestine | A501158 | Biochain | Small Intestine | PM | M/63 | |
| 6-B-Rectum | A605138 | Biochain | Rectum | PM | M/25 | |
| 7-B-Rectum | A610297 | Biochain | Rectum | PM | M/24 | |
| 8-B-Rectum | A610298 | Biochain | Rectum | PM | M/27 | |
| 9-Am-Stomach | 110P04A | Ambion | Stomach | PM GSW | M/16 | |
| 10-B-Stomach | A501159 | Biochain | Stomach | PM | M/24 | |
| 11-B-Esophagus | A603814 | Biochain | Esophagus | PM | M/26 | |
| 12-B-Esophagus | A603813 | Biochain | Esophagus | PM | M/41 | |
| 13-Am-Pancreas | 071P25C | Ambion | Pancreas | PM MVA | F/25 | |
| 14-CG-Pancreas | CG-255-2 | Ichilov | Pancreas | PM | M/75 | |
| 15-B-Lung | A409363 | Biochain | Lung | PM-Pool of 5 | M(24-28)&F62 | |
| 16-Am-Lung (L93) | 111P0103A | Ambion | Lung | PM ICH | F/61 | |
| 17-B-Lung (L92) | A503204 | Biochain | Lung | PM | M/28 | |
| 19-B-Ovary (O48) | A504087 | Biochain | Ovary | PM | F/51 | |
| 20-B-Ovary (O46) | A504086 | Biochain | Ovary | PM | F/41 | |
| 75-G-Ovary | L629FRV1 | GCI | Ovary | PS DIGESTIVE HEMORRHAGE (ALCOHOLISM) | F/47 | |
| 76-G-Ovary | DWHTZRQX | GCI | Ovary | PS LEIOMYOMAS | F/42 | |
| 77-G-Ovary | FDPL9NJ6 | GCI | Ovary | PS VAGINAL BLEEDING | F/56 | |
| 78-G-Ovary | GWXUZN5M | GCI | Ovary | PS ABNORMAL PAP SMEARS | F/53 | |
| 21-Am-Cervix | 101P0101A | Ambion | Cervix | PM Surgery | F/40 | |
| 23-B-Cervix | A504089 | Biochain | Cervix | PM-Pool of 5 | F (36-55) | |
| 24-B-Uterus | A411074 | Biochain | Uterus | PM-Pool of 10 | F (32-53) | |
| 25-B-Uterus | A409248 | Biochain | Uterus | PM | F/35 | |
| 26-B-Uterus | A504090 | Biochain | Uterus | PM-Pool of 5 | F(40-53) | |
| 28-Am-Bladder | 071P02C | Ambion | Bladder | PM GSW | M/28 | |
| 29-B-Bladder | A504088 | Biochain | Bladder | PM-Pool of 5 | M(26-44)&F30 | |
| 30-Am-Placenta | 021P33A | Ambion | Placenta | PB | F/33 | PB—post birth |
| 31-B-Placenta | A410165 | Biochain | Placenta | PB | F/26 | |
| 32-B-Placenta | A411073 | Biochain | Placenta | PB-Pool of 5 | F(24-30) | |
| 33-B-Breast (B59) | A607155 | Biochain | Breast | PM | F/36 | |
| 34-Am-Breast (B63) | 26486 | Ambion | Breast | PS bilateral breast reduction | F/43 | |
| 35-Am-Breast (B64) | 23036 | Ambion | Breast | PM lung cancer | F/57 | |
| 36-Cl-Prostate (P53) | 1070317 | Clontech | Prostate | PM-Pool of 47 sudden death | M (14-57) | |
| 37-Am-Prostate (P42) | 061P04A | Ambion | Prostate | PM IC bleed | M/47 | |
| 38-Am-Prostate (P59) | 25955 | Ambion | Prostate | PM head trauma | M/62 | |
| 39-Am-Testis | 111P0104A | Ambion | Testis | PM GSW | M/25 | |
| 40-B-Testis | A411147 | Biochain | Testis | PM | M/74 | |
| 41-Cl-Testis | 1110320 | Clontech | Testis | PM-Pool of 45 sudden death | M (14-64) | |
| 42-CG-Adrenal | CG-184-10 | Ichilov | Adrenal | PM | F/81 | |
| 43-B-Adrenal | A610374 | Biochain | Adrenal | PM | F/83 | |
| 44-B-Heart | A411077 | Biochain | Heart | PM-Pool of 5 | M(23-70) | |
| 45-CG-Heart | CG-255-9 | Ichilov | Heart focal fibrosis | PM | M/75 | |
| 46-CG-Heart | CG-227-1 | Ichilov | Heart | PM | F/36 | |
| 47-Am-Liver | 081P0101A | Ambion | Liver | PM ICH | M/64 | |

TABLE 5-continued

Tissue samples in normal panel:

| | Lot no. | Source | Tissue | Pathology | Sex/Age | comments |
|---|---|---|---|---|---|---|
| 48-CG-Liver | CG-93-3 | Ichilov | Liver | PM | F/19 | |
| 49-CG-Liver | CG-124-4 | Ichilov | Liver of fetus | PM | fetus | |
| 50-Cl-BM | 1110932 | Clontech | Bone Marrow | PM-Pool of 8 sudden death | M&F (22-65) | |
| 51-CGEN-Blood | WBC#5 | CGEN | Blood | — | M | |
| 52-CGEN-Blood | WBC#4 | CGEN | Blood | — | M | |
| 53-CGEN-Blood | WBC#3 | CGEN | Blood | — | M | |
| 54-CG-Spleen | CG-267 | Ichilov | Spleen | PM | F/25 | |
| 55-CG-Spleen | 111P0106B | Ambion | Spleen | PM GSW | M/25 | |
| 56-CG-Spleen | A409246 | Biochain | Spleen | PM | F/12 | |
| 57-CG-Thymus | CG-98-7 | Ichilov | Thymus | PM | F/28 | |
| 58-Am-Thymus | 101P0101A | Ambion | Thymus | PM head injury | M/14 | |
| 59-B-Thymus | A409278 | Biochain | Thymus | PM | M/28 | |
| 60-B-Thyroid | A610287 | Biochain | Thyroid | PM | M/27 | |
| 61-B-Thyroid | A610286 | Biochain | Thyroid | PM | M/24 | |
| 62-CG-Thyroid | CG-119-2 | Ichilov | Thyroid | PM | F/66 | |
| 63-Cl-Salivary Gland | 1070319 | Clontech | Salivary Gland | PM-Pool of 24 sudden death | M&F 15-60 | |
| 64-Am-Kidney | 111P0101B | Ambion | Kidney | PM ICH | M 60 | |
| 65-Cl-Kidney | 1110970 | Clontech | Kidney | PM-Pool of 14 sudden death | M&F 18-59 | |
| 66-B-Kidney | A411080 | Biochain | Kidney | PM-Pool of 5 | M24-46 | |
| 67-CG-Cerebellum | CG-183-5 | Ichilov | Cerebellum | PM | M/74 | |
| 68-CG-Cerebellum | CG-212-5 | Ichilov | Cerebellum | PM | M/54 | |
| 69-B-Brain | A411322 | Biochain | Brain | PM | M/28 | |
| 70-Cl-Brain | 1120022 | Clontech | Brain | PM | — | |
| 71-B-Brain | A411079 | Biochain | Brain | PM-Pool of 2 | M27-28 | |
| 72-CG-Brain | CG-151-1 | Ichilov | Brain | PM | F/86 | |
| 73-Am-Skeletal Muscle | 101P013A | Ambion | Skeletal Muscle | PM head injury | F/28 | |
| 74-Cl-Skeletal Muscle | 1061038 | Clontech | Skeletal Muscle | PM-Pool of 2 sudden death | M&F 43-46 | |

TABLE 5_1

Normal panel

| | | | | | |
|---|---|---|---|---|---|
| 7-B-Rectum | 1-(7)-Bc-Rectum | Biochain | A610297 | | |
| 8-B-Rectum | 2-(8)-Bc-Rectum | Biochain | A61298 | | |
| new colon | 3-GC-Colon | GCI | CDSUV | CDSUVNR3 | |
| new colon | 4-As-Colon | Asterand | 16364 | 31802 | 31802B1 |
| new colon | 5-As-Colon | Asterand | 22900 | 74446 | 74446B1 |
| new small bowl | 6-GC-Small bowl | GCI | V9L7D | V9L7DN6Z | |
| new small bowl | 7-GC-Small bowl | GCI | M3GVT | M3GVTN5R | |
| new small bowl | 8-GC-Small bowl | GCI | 196S2 | 196S2AJN | |
| 9-Am-Stomach | 9-(9)-Am-Stomach | Ambion | 110P04A | | |
| 10-B-Stomach | 10-(10)-Bc-Stomach | Biochain | A501159 | | |
| 11-B-Esophagus | 11-(11)-Bc-Esoph | Biochain | A603814 | | |
| 12-B-Esophagus | 12-(12)-Bc-Esoph | Biochain | A603813 | | |
| new pancreas | 13-As-Panc | Asterand | 8918 | 9442 | 9442C1 |
| new pancreas | 14-As-Panc | Asterand | 10082 | 11134 | 11134B1 |
| 48-CG-Liver | 15-(48)-Ic-Liver | Ichilov | CG-93-3 | | |
| new liver | 16-As-Liver | Asterand | 7916 | 7203 | 7203B1 |
| 28-Am-Bladder | 17-(28)-Am-Bladder | Ambion | 071P02C | | |
| 29-B-Bladder | 18-(29)-Bc-Bladder | Biochain | A504088 | | |
| 64-Am-Kidney | 19-(64)-Am-Kidney | Ambion | 111P0101B | | |
| 65-CI-Kidney | 20-(65)-CI-Kidney | Clontech | 1110970 | | |
| 66-B-Kidney | 21-(66)-Bc-Kidney | Biochain | A411080 | | |
| new kidney | 22-GC-Kidney | GCI | N1EVZ | N1EVZN91 | |
| new kidney | 23-GC-Kidney | GCI | BMI6W | BMI6WN9F | |
| 42-CG-Adrenal | 24-(42)-Ic-Adrenal | Ichilov | CG-184-10 | | |
| 43-B-Adrenal | 25-(43)-Bc-Adrenal | Biochain | A610374 | | |
| 16-Am-Lung (L93) | 26-(16)-Am-Lung | Ambion | 111P0103A | | |
| 17-B-Lung (L92) | 27-(17)-Bc-Lung | Biochain | A503204 | | |
| new lung | 28-As-Lung | Asterand | 9078 | 9275 | 9275B1 |
| new lung | 29-As-Lung | Asterand | 6692 | 6161 | 6161A1 |
| new lung | 30-As-Lung | Asterand | 7900 | 7180 | 7180F1 |
| 75-G-Ovary | 31-(75)-GC-Ovary | GCI | L629FRV1 | | |
| 76-G-Ovary | 32-(76)-GC-Ovary | GCI | DWHTZRQX | | |
| 77-G-Ovary | 33-(77)-GC-Ovary | GCI | FDPL9NJ6 | | |
| 78-G-Ovary | 34-(78)-GC-Ovary | GCI | GWXUZN5M | | |
| 21-Am-Cervix | 35-(21)-Am-Cerix | Ambion | 101P0101A | | |
| new cervix | 36-GC-cervix | GCI | E2P2N | E2P2NAP4 | |
| 24-B-Uterus | 37-(24)-Bc-Uterus | Biochain | A411074 | | |
| 26-B-Uterus | 38-(26)-Bc-Uterus | Biochain | A504090 | | |
| 30-Am-Placenta | 39-(30)-Am-Placen | Ambion | 021P33A | | |
| 32-B-Placenta | 40-(32)-Bc-Placen | Biochain | A411073 | | |

TABLE 5_1-continued

| Normal panel | | | | | |
|---|---|---|---|---|---|
| new breast | 41-GC-Breast | GCI | DHLR1 | | |
| new breast | 42-GC-Breast | GCI | TG6J6 | | |
| new breast | 43-GC-Breast | GCI | E6UDD | E6UDDNCF | |
| 38-Am-Prostate (P59) | 44-(38)-Am-Prostate | Ambion | 25955 | | |
| add prostate from prostate panel | 45-Bc-Prostate | Biochain | A609258 | | |
| new testis | 46-As-Testis | Asterand | 13071 | 19567 | 19567B1 |
| new testis | 47-As-Testis | Asterand | 19671 | 42120 | 42120A1 |
| ARTERY | 48-GC-Artery | GCI | 7FUUP | 7FUUPAMP | |
| ARTERY | 49-GC-Artery | GCI | YGTVY | YGTVYAIN | |
| blood cells? | 50-Th-Blood-MONO | Tel-Hashomer | 52497 | | |
| blood cells? | 51-Th-Blood-MONO | Tel-Hashomer | 31055 | | |
| blood cells? | 52-Th-Blood-MONO | Tel-Hashomer | 31058 | | |
| 54-CG-Spleen | 53-(54)-Ic-Spleen | Ichilov | CG-267 | | |
| 55-CG-Spleen | 54-(55)-Ic-Spleen | Ichilov | 111P0106B | | |
| 57-CG-Thymus | 55-(57)-Ic-Thymus | Ichilov | CG-98-7 | | |
| 58-Am-Thymus | 56-(58)-Am-Thymus | Ambion | 101P0101A | | |
| 60-B-Thyroid | 57-(60)-Bc-Thyroid | Biochain | A610287 | | |
| 62-CG-Thyroid | 58-(62)-Ic-Thyroid | Ichilov | CG-119-2 | | |
| new salivary gland | 59-Gc-Sali gland | GCI | NNSMV | NNSMVNJC | |
| 67-CG-Cerebellum | 60-(67)-Ic-Cerebellum | Ichilov | CG-183-5 | | |
| 68-CG-Cerebellum | 61-(68)-Ic-Cerebellum | Ichilov | CG-212-5 | | |
| 69-B-Brain | 62-(69)-Bc-Brain | Biochain | A411322 | | |
| 71-B-Brain | 63-(71)-Bc-Brain | Biochain | A411079 | | |
| 72-CG-Brain | 64-(72)-Ic-Brain | Ichilov | CG-151-1 | | |
| 44-B-Heart | 65-(44)-Bc-Heart | Biochain | A411077 | | |
| 46-CG-Heart | 66-(46)-Ic-Heart | Ichilov | CG-227-1 | | |
| 45-CG-Heart (Fibrotic) | 67-(45)-Ic-Heart (Fibrotic) | Ichilov | CG-255-9 | | |
| new skeletal muscle | 68-GC-Skel Mus | GCI | T8YZS | T8YZSN7O | |
| new skeletal muscle | 69-GC-Skel Mus | GCI | Q3WKA | Q3WKANCJ | |
| new skeletal muscle | 70-As-Skel Mus | Asterand | 8774 | 8235 | 8235G1 |
| new skeletal muscle | 71-As-Skel Mus | Asterand | 8775 | 8244 | 8244A1 |
| new skeletal muscle | 72-As-Skel Mus | Asterand | 10937 | 12648 | 12648C1 |
| new skeletal muscle | 73-As-Skel Mus | Asterand | 6692 | 6166 | 6166A1 |

Materials and Experimental Procedures

RNA preparation—RNA was obtained from ABS (Wilmington, Del. 19801, USA), BioChain Inst. Inc. (Hayward, Calif. 94545 USA), GOG for ovary samples—Pediatic Cooperative Human Tissue Network, Gynecologic Oncology Group Tissue Bank, Children Hospital of Columbus (Columbus Ohio 43205 USA), Clontech (Franklin Lakes, N.J. USA 07417), Ambion (Austin, Tex. 78744 USA), Asternad (Detroit, Mich. 48202-3420, USA), and from Genomics Collaborative Inc. a Division of Seracare (Cambridge, Mass. 02139, USA). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Real-Time RT-PCR analysis—cDNA (5 µl), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q = \text{efficiency}^{-Ct}$. The efficiency of the PCR reaction was calculated from a standard curve, created by using serial dilutions of several reverse transcription (RT) reactions. prepared from RNA purified from 5 cell lines (HCT116, H1299, DU145, MCF7, ES-2). To minimize inherent differences in the RT reaction, the resulting relative quantities were normalized to normalization factor calculated in one of the following methods as indicated in the text:

Method 1—the geometric mean of the relative quantities of the selected housekeeping (HSKP) genes was used as normalization factor.

Figure 3:
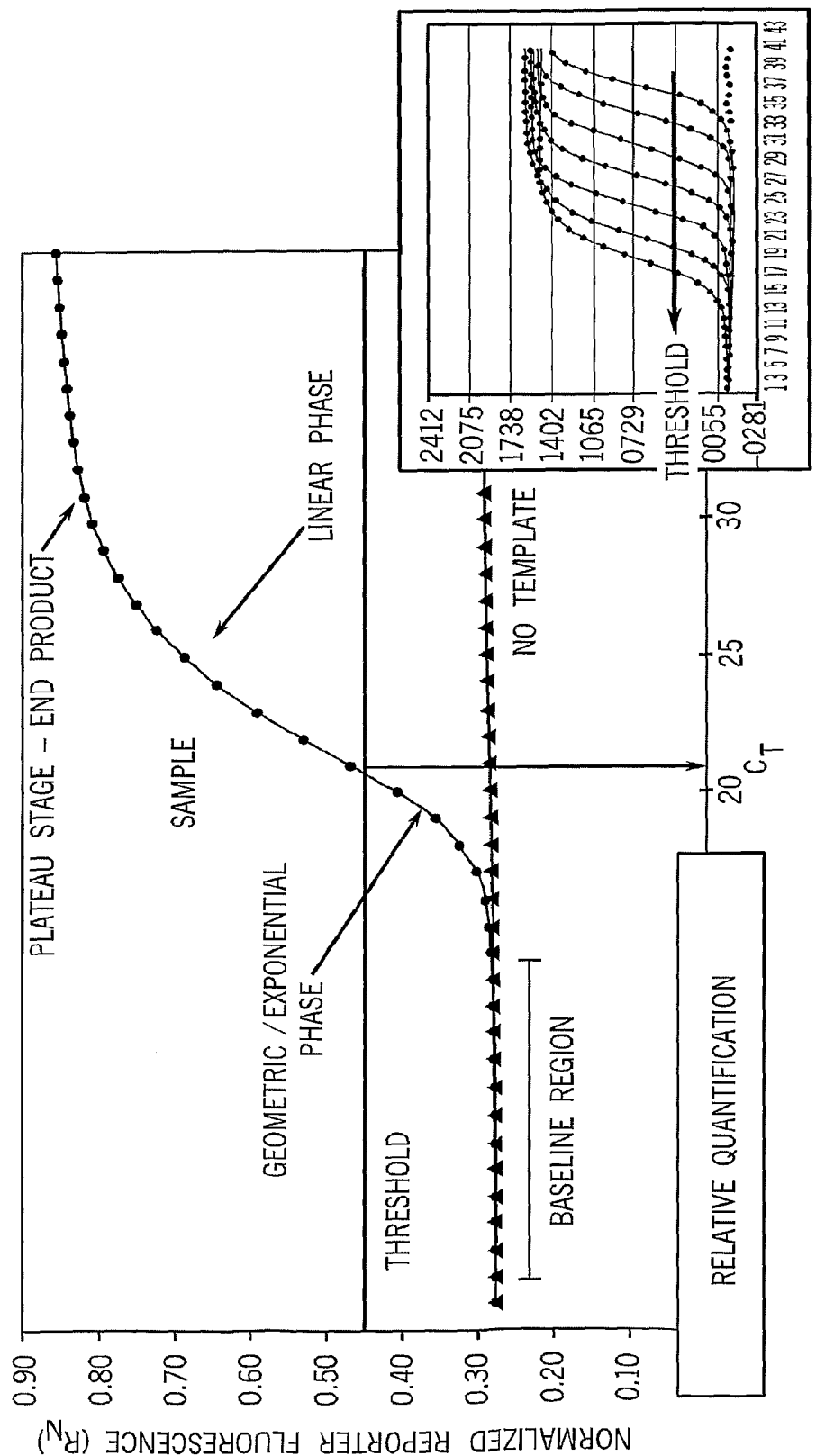
FIG. 3 shows the schematic summary of quantitative real-time PCR analysis.

Method 2—The expression of several housekeeping (HSKP) genes was checked on every panel. The relative quantity (Q) of each housekeeping gene in each sample, calculated as described above, was divided by the median quantity of this gene in all panel samples to obtain the "relative Q rel to MED". Then, for each sample the median of the "relative Q rel to MED" of the selected housekeeping genes was calculated and served as normalization factor of this sample for further calculations. Schematic summary of quantitative real-time PCR analysis is presented in FIG. 3. As shown, the x-axis shows the cycle number. The $C_T$=Threshold Cycle point, which is the cycle that the amplification curve crosses the fluorescence threshold that was set in the experiment. This point is a calculated cycle number in which PCR products signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples on the ovary cancer tissue testing panel were as follows:

```
SDHA (GenBank Accession No. NM_004168
(SEQ ID NO: 364),)
SDHA Forward primer
(SEQ ID NO: 556):
TGGGAACAAGAGGGCATCTG
SDHA Reverse primer
(SEQ ID NO: 557):
CCACCACTGCATCAAATTCATG
SDHA-amplicon (SEQ ID NO: 365):
TGGGAACAAGAGGGCATCTGCTAAAGTTTCAGATTCCATTTCTGCTCAG
TATCCAGTAGTGGATCATGAATTTGATGCAGTGGTGG PBGD (GenBank Accession No. BC019323
(SEQ ID NO: 381),),
PBGD Forward primer
(SEQ ID NO: 558):
TGAGAGTGATTCGCGTGGG
PBGD Reverse primer
(SEQ ID NO: 559):
CCAGGGTACGAGGCTTTCAAT
PBGD-amplicon (SEQ ID NO: 382):
TGAGAGTGATTCGCGTGGGTACCCGCAAGAGCCAGCTTGCTCGCATACA
GACGGACAGTGTGGTGGCAACATTGAAAGCCTCGTACCCTGG HPRT1 (GenBank Accession No. NM_000194
(SEQ ID NO: 379),
HPRT1 Forward primer
(SEQ ID NO: 560):
TGACACTGGCAAAACAATGCA
HPRT1 Reverse primer
(SEQ ID NO: 561):
GGTCCTTTTCACCAGCAAGCT
HPRT1-amplicon
(SEQ ID NO: 380):
TGACACTGGCAAAACAATGCAGACTTTGCTTTCCTTGGTCAGGCAGTAT
AATCCAAAGATGGTCAAGGTCGCAAGCTTGCTGGTGAAAAGGACC GAPDH (GenBank Accession No. BC026907
(SEQ ID NO: 451))
GAPDH Forward primer
(SEQ ID NO: 562):
TGCACCACCAACTGCTTAGC
GAPDH Reverse primer
(SEQ ID NO: 563):
CCATCACGCCACAGTTTCC
GAPDH-amplicon
(SEQ ID NO: 450):
TGCACCACCAACTGCTTAGCACCCCTGGCCAAGGTCATCCATGACAACT
TTGGTATCGTGGAAGGACTCATGACCACAGTCCATGCCATCACTGCCAC
CCAGAAGACTGTGGATGG
```

The sequences of the housekeeping genes measured in all the examples on colon cancer tissue testing panel were as follows:

```
PBGD (GenBank Accession No. BC019323
(SEQ ID NO: 381)),
PBGD Forward primer
(SEQ ID NO: 558):
TGAGAGTGATTCGCGTGGG
PBGD Reverse primer
(SEQ ID NO: 559):
CCAGGGTACGAGGCTTTCAAT
PBGD-amplicon
(SEQ ID NO: 382)::
TGAGAGTGATTCGCGTGGGTACCCGCAAGAGCCAGCTTGCTCGCATACA
GACGGACAGTGTGGTGGCAACATTGAAAGCCTCGTACCCTGG HPRT1 (GenBank Accession No. NM_000194
(SEQ ID NO: 379),
HPRT1 Forward primer
(SEQ ID NO: 560):
TGACACTGGCAAAACAATGCA
HPRT1 Reverse primer
(SEQ ID NO: 561):
GGTCCTTTTCACCAGCAAGCT
HPRT1-amplicon
(SEQ ID NO: 380):
TGACACTGGCAAAACAATGCAGACTTTGCTTTCCTTGGTCAGGCAGTAT
AATCCAAAGATGGTCAAGGTCGCAAGCTTGCTGGTGAAAAGGACC G6PD (GenBank Accession No. NM_000402
(SEQ ID NO: 405))
G6PDForward primer
(SEQ ID NO: 564):
gaggccgtcaccaagaacat
G6PD Reverse primer
(SEQ ID NO: 565):
ggacagccggtcagagctc
G6PD-amplicon
(SEQ ID NO: 404):
gaggccgtcaccaagaacattcacgagtcctgcatgagccagataggct
ggaaccgcatcatcgtggagaagcccttcgggagggacctgcagagctc
tgaccggctgtcc RPS27A (GenBank Accession No. NM_002954
(SEQ ID NO: 403),)
RPS27A Forward primer
(SEQ ID NO: 566):
CTGGCAAGCAGCTGGAAGAT
RPS27A Reverse primer
(SEQ ID NO: 567):
TTTCTTAGCACCACCACGAAGTC
RPS27A-amplicon
(SEQ ID NO: 402):
CTGGCAAGCAGCTGGAAGATGGACGTACTTTGTCTGACTACAATATTCA
AAAGGAGTCTACTCTTCATCTTGTGTTGAGACTTCGTGGTGGTGCTAAG
AAA
```

The sequences of the housekeeping genes measured in all the examples in the lung panel were as follows:

```
Ubiquitin (GenBank Accession No. BC000449
(SEQ ID NO: 366),)
Ubiquitin Forward primer
(SEQ ID NO: 568):
ATTTGGGTCGCGGTTCTTG
Ubiquitin Reverse primer
(SEQ ID NO: 569):
TGCCTTGACATTCTCGATGGT
Ubiquitin-amplicon
(SEQ ID NO: 367):
ATTTGGGTCGCGGTTCTTGTTTGTGGATCGCTGTGATCGTCACTTGACA
ATGCAGATCTTCGTGAAGACTCTGACTGGTAAGACCATCACCCTCGAGG
TTGAGCCCAGTGACACCATCGAGAATGTCAAGGCA SDHA (GenBank Accession No. NM_004168
(SEQ ID NO: 364),)
SDHA Forward primer
(SEQ ID NO: 556):
TGGGAACAAGAGGGCATCTG
SDHA Reverse primer
(SEQ ID NO: 557):
CCACCACTGCATCAAATTCATG
SDHA-amplicon
(SEQ ID NO: 365):
TGGGAACAAGAGGGCATCTGCTAAAGTTTCAGATTCCATTTCTGCTCAG
TATCCAGTAGTGGATCATGAATTTGATGCAGTGGTGG PBGD (GenBank Accession No. BC019323
(SEQ ID NO: 381)),
PBGD Forward primer
(SEQ ID NO: 558):
TGAGAGTGATTCGCGTGGG
```

-continued

PBGD Reverse primer
(SEQ ID NO: 559):
CCAGGGTACGAGGCTTTCAAT
PBGD-amplicon
(SEQ ID NO: 382):
TGAGAGTGATTCGCGTGGGTACCCGCAAGAGCCAGCTTGCTCGCATACA
GACGGACAGTGTGGTGGCAACATTGAAAGCCTCGTACCCTGG HPRT1 (GenBank Accession No. NM_000194
(SEQ ID NO: 379)),
HPRT1 Forward primer
(SEQ ID NO: 560):
TGACACTGGCAAAACAATGCA
HPRT1 Reverse primer
(SEQ ID NO: 561):
GGTCCTTTTCACCAGCAAGCT
HPRT1-amplicon
(SEQ ID NO: 380):
TGACACTGGCAAAACAATGCAGACTTTGCTTTCCTTGGTCAGGCAGTAT
AATCCAAAGATGGTCAAGGTCGCAAGCTTGCTGGTGAAAAGGACC The sequences of the housekeeping genes measured in all the examples on breast cancer panel were as follows:

G6PD (GenBank Accession No. NM_000402
(SEQ ID NO: 405))

G6PD Forward primer (SEQ ID NO: 564):
gaggccgtcaccaagaacat

G6PD Reverse primer (SEQ ID NO: 565):
ggacagccggtcagagctc

G6PD-amplicon (SEQ ID NO: 404):
gaggccgtcaccaagaacattcacgagtcctgcatgagccagataggctgg
aaccgcatcatcgtggagaagcccttcgggagggacctgcagagctctgac
cggctgtcc SDHA (GenBank Accession No. NM_004168
(SEQ ID NO: 364),)

SDHA Forward primer (SEQ ID NO: 556):
TGGGAACAAGAGGGCATCTG

SDHA Reverse primer (SEQ ID NO: 557):
CCACCACTGCATCAAATTCATG

SDHA-amplicon (SEQ ID NO: 365):
TGGGAACAAGAGGGCATCTGCTAAAGTTTCAGATTCCATTTCTGCTCAGTA
TCCAGTAGTGGATCATGAATTTGATGCAGTGGTGG PBGD (GenBank Accession No. BC019323
(SEQ ID NO: 381)), PBGD Forward primer (SEQ ID NO: 558):
TGAGAGTGATTCGCGTGGG PBGD Reverse primer (SEQ ID NO: 559):
CCAGGGTACGAGGCTTTCAAT PBGD-amplicon (SEQ ID NO: 382):
TGAGAGTGATTCGCGTGGGTACCCGCAAGAGCCAGCTTGCTCGCATACAGA
CGGACAGTGTGGTGGCAACATTGAAAGCCTCGTACCCTGG HPRT1 (GenBank Accession No. NM_000194
(SEQ ID NO: 379), HPRT1 Forward primer (SEQ ID NO: 560):
TGACACTGGCAAAACAATGCA HPRT1 Reverse primer (SEQ ID NO: 561):
GGTCCTTTTCACCAGCAAGCT HPRT1-amplicon (SEQ ID NO: 380):
TGACACTGGCAAAACAATGCAGACTTTGCTTTCCTTGGTCAGGCAGTATAA
TCCAAAGATGGTCAAGGTCGCAAGCTTGCTGGTGAAAAGGACC The sequences of the housekeeping genes measured in all the examples on normal tissue samples panel were as follows:

RPL19 (GenBank Accession No. NM_000981
(SEQ ID NO: 369))
RPL19Forward primer
(SEQ ID NO: 570):
TGGCAAGAAGAAGGTCTGGTTAG
RPL19Reverse primer
(SEQ ID NO: 571):
TGATCAGCCCATCTTTGATGAG
RPL19-amplicon
(SEQ ID NO: 368):
TGGCAAGAAGAAGGTCTGGTTAGACCCCAATGAGACCAATGAAATCGCC
AATGCCAACTCCCGTCAGCAGATCCGGAAGCTCATCAAAGATGGGCTGA
TCA TATAbox (GenBank Accession No. NM_003194
(SEQ ID NO: 371)),
TATA box Forward primer
(SEQ ID NO: 572):
CGGTTTGCTGCGGTAATCAT
TATA box Reverse primer
(SEQ ID NO: 573):
TTTCTTGCTGCCAGTCTGGAC
TATA (SEQ ID NO: 370) box-amplicon:
CGGTTTGCTGCGGTAATCATGAGGATAAGAGAGCCACGAACCACGGCAC
TGATTTTCAGTTCTGGGAAAATGGTGTGCACAGGAGCCAAGAGTGAAGA
ACAGTCCAGACTGGCAGCAAGAAA Ubiquitin (GenBank Accession No. BC000449
(SEQ ID NO: 366))
Ubiquitin Forward primer
(SEQ ID NO: 568):
ATTTGGGTCGCGGTTCTTG
Ubiquitin Reverse primer
(SEQ ID NO: 569):
TGCCTTGACATTCTCGATGGT
Ubiquitin-amplicon
(SEQ ID NO: 367):
ATTTGGGTCGCGGTTCTTGTTTGTGGATCGCTGTGATCGTCACTTGACA
ATGCAGATCTTCGTGAAGACTCTGACTGGTAAGACCATCACCCTCGAGG
TTGAGCCCAGTGACACCATCGAGAATGTCAAGGCA SDHA (GenBank Accession No. NM_004168
(SEQ ID NO: 364),)
SDHA Forward primer
(SEQ ID NO: 556):
TGGGAACAAGAGGGCATCTG
SDHA Reverse primer
(SEQ ID NO: 557):
CCACCACTGCATCAAATTCATG
SDHA-amplicon
(SEQ ID NO: 365):
TGGGAACAAGAGGGCATCTGCTAAAGTTTCAGATTCCATTTCTGCTCAG
TATCCAGTAGTGGATCATGAATTTGATGCAGTGGTGG Cluster HSFLT Cluster HSFLT features at least 15 transcript(s) and at least 58 segment(s) of interest, the names for which are described in Tables 6 and 7, respectively and certain protein variants are described in table 8.

TABLE 6

| Transcripts |
|---|
| Transcript Name |
| HSFLT_T7 (SEQ ID NO: 1) |
| HSFLT_T8 (SEQ ID NO: 2) |
| HSFLT_T9 (SEQ ID NO: 3) |
| HSFLT_T10 (SEQ ID NO: 4) |
| HSFLT_T13 (SEQ ID NO: 5) |
| HSFLT_T14 (SEQ ID NO: 6) |
| HSFLT_T17 (SEQ ID NO: 7) |

TABLE 6-continued

| Transcripts Transcript Name |
|---|
| HSFLT_T19 (SEQ ID NO: 8) |
| HSFLT_T20 (SEQ ID NO: 9) |
| HSFLT_T21 (SEQ ID NO: 10) |
| HSFLT_T22 (SEQ ID NO: 11) |
| HSFLT_T23 (SEQ ID NO: 12) |
| HSFLT_T24 (SEQ ID NO: 13) |
| HSFLT_T25 (SEQ ID NO: 14) |
| HSFLT_T26 (SEQ ID NO: 15) |

TABLE 7

| Segments Segment Name |
|---|
| HSFLT_N0 (SEQ ID NO: 32) |
| HSFLT_N5 (SEQ ID NO: 33) |
| HSFLT_N6 (SEQ ID NO: 34) |
| HSFLT_N8 (SEQ ID NO: 35) |
| HSFLT_N9 (SEQ ID NO: 36) |
| HSFLT_N11 (SEQ ID NO: 37) |
| HSFLT_N14 (SEQ ID NO: 38) |
| HSFLT_N15 (SEQ ID NO: 39) |
| HSFLT_N17 (SEQ ID NO: 40) |
| HSFLT_N19 (SEQ ID NO: 41) |
| HSFLT_N20 (SEQ ID NO: 42) |
| HSFLT_N24 (SEQ ID NO: 43) |
| HSFLT_N26 (SEQ ID NO: 44) |
| HSFLT_N30 (SEQ ID NO: 45) |
| HSFLT_N38 (SEQ ID NO: 46) |
| HSFLT_N41 (SEQ ID NO: 47) |
| HSFLT_N42 (SEQ ID NO: 48) |
| HSFLT_N44 (SEQ ID NO: 49) |
| HSFLT_N46 (SEQ ID NO: 50) |
| HSFLT_N48 (SEQ ID NO: 51) |
| HSFLT_N52 (SEQ ID NO: 52) |
| HSFLT_N59 (SEQ ID NO: 53) |
| HSFLT_N63 (SEQ ID NO: 54) |
| HSFLT_N68 (SEQ ID NO: 55) |
| HSFLT_N74 (SEQ ID NO: 56) |
| HSFLT_N82 (SEQ ID NO: 57) |
| HSFLT_N93 (SEQ ID NO: 58) |
| HSFLT_N98 (SEQ ID NO: 59) |
| HSFLT_N100 (SEQ ID NO: 60) |
| HSFLT_N103 (SEQ ID NO: 530) |
| HSFLT_N3 (SEQ ID NO: 502) |
| HSFLT_N22 (SEQ ID NO: 503) |
| HSFLT_N28 (SEQ ID NO: 504) |
| HSFLT_N32 (SEQ ID NO: 505) |
| HSFLT_N34 (SEQ ID NO: 506) |
| HSFLT_N36 (SEQ ID NO: 507) |
| HSFLT_N50 (SEQ ID NO: 508) |
| HSFLT_N55 (SEQ ID NO: 509) |
| HSFLT_N57 (SEQ ID NO: 510) |
| HSFLT_N61 (SEQ ID NO: 511) |
| HSFLT_N65 (SEQ ID NO: 512) |
| HSFLT_N66 (SEQ ID NO: 513) |
| HSFLT_N70 (SEQ ID NO: 514) |
| HSFLT_N72 (SEQ ID NO: 515) |
| HSFLT_N75 (SEQ ID NO: 516) |
| HSFLT_N77 (SEQ ID NO: 517) |
| HSFLT_N78 (SEQ ID NO: 518) |
| HSFLT_N79 (SEQ ID NO: 519) |
| HSFLT_N84 (SEQ ID NO: 520) |
| HSFLT_N88 (SEQ ID NO: 521) |
| HSFLT_N91 (SEQ ID NO: 522) |
| HSFLT_N92 (SEQ ID NO: 523) |
| HSFLT_N94 (SEQ ID NO: 524) |
| HSFLT_N95 (SEQ ID NO: 525) |
| HSFLT_N97 (SEQ ID NO: 526) |
| HSFLT_N99 (SEQ ID NO: 527) |
| HSFLT_N101 (SEQ ID NO: 528) |
| HSFLT_N102 (SEQ ID NO: 529) |

TABLE 8

Proteins and their Corresponding Transcript Descriptions:

| Protein Name | Corresponding Transcript(s) |
|---|---|
| HSFLT_P6 (SEQ ID NO: 16) | HSFLT_T9 (SEQ ID NO: 3) |
| HSFLT_P7 (SEQ ID NO: 17) | HSFLT_T10 (SEQ ID NO: 4) |

TABLE 8-continued

Proteins and their Corresponding Transcript Descriptions:

| Protein Name | Corresponding Transcript(s) |
|---|---|
| HSFLT_P10 (SEQ ID NO: 18) | HSFLT_T13 (SEQ ID NO: 5) |
| HSFLT_P11 (SEQ ID NO: 19) | HSFLT_T14 (SEQ ID NO: 6) |
| HSFLT_P13 (SEQ ID NO: 20) | HSFLT_T17 (SEQ ID NO: 7) |
| HSFLT_P14 (SEQ ID NO: 21) | HSFLT_T19 (SEQ ID NO: 8) |
| HSFLT_P15 (SEQ ID NO: 22) | HSFLT_T20 (SEQ ID NO: 9) |
| HSFLT_P16 (SEQ ID NO: 23) | HSFLT_T21 (SEQ ID NO: 10) |
| HSFLT_P17 (SEQ ID NO: 24) | HSFLT_T22 (SEQ ID NO: 11) |
| HSFLT_P18 (SEQ ID NO: 25) | HSFLT_T23 (SEQ ID NO: 12) |
| HSFLT_P19 (SEQ ID NO: 26) | HSFLT_T24 (SEQ ID NO: 13) |
| HSFLT_P20 (SEQ ID NO: 27) | HSFLT_T25 (SEQ ID NO: 14) |
| HSFLT_P21 (SEQ ID NO: 28) | HSFLT_T26 (SEQ ID NO: 15) |
| HSFLT_P41 (SEQ ID NO: 29) | HSFLT_T21 (SEQ ID NO: 10) |
| HSFLT_P48 (SEQ ID NO: 30) | HSFLT_T7 (SEQ ID NO: 1) |
| HSFLT_P49 (SEQ ID NO: 31) | HSFLT_T8 (SEQ ID NO: 2) |

The sequences listed in Tables 8 comprise variants of the known protein Vascular endothelial growth factor receptor 1 precursor (SwissProt accession identifier VGR1_HUMAN (SEQ ID NO: 359); known also according to the synonyms EC 2.7.1.112; VEGFR-1; Vascular permeability factor receptor; Tyrosine-protein kinase receptor FLT; Flt-1; Tyrosine-protein kinase FRT; Fms-like tyrosine kinase 1)), and may be referred to herein as "the corresponding native protein".

Protein Vascular endothelial growth factor receptor 1 precursor is associated with the following function(s): it is a eceptor for VEGF, VEGFB and PGF, has tyrosine-protein kinase activity. The VEGF-kinase ligand/receptor signaling system plays a key role in vascular development and regulation of vascular permeability. Isoform SFlt1 may have an inhibitory role in angiogenesis. The sequence for protein Vascular endothelial growth factor receptor 1 precursor is given at the end of the application, as "Vascular endothelial growth factor receptor 1 precursor amino acid sequence". Known polymorphisms for this sequence include an SNP at amino acid position 779, having an L to F substitution.

According to this aspect of the invention and in some embodiments, the polypeptides related thereto, and polynucleotides encoding the same, may be useful in applications in the following: angiogenesis inhibition; angiogenesis stimulation; endothelial growth factor agonism; endothelial growth factor receptor kinase inhibition, or combinations thereof.

In some embodiments, related polypeptides/polynucleotides of this invention will accordingly have the following therapeutic indication: anticancer, cardiovascular; growth stimulation; antidiabetic; vulnerary, or others.

The following GO Annotation(s) apply to the previously known protein. The following annotation(s) were found: positive regulation of cell proliferation; pregnancy; transmembrane receptor protein tyrosine kinase signaling pathway, which are annotation(s) related to Biological Process; receptor activity; vascular endothelial growth factor receptor activity, which are annotation(s) related to Molecular Function; and extracellular space; integral to plasma membrane, which are annotation(s) related to Cellular Component.

The GO assignment relies on information from one or more of the SwissProt/TremBl Protein knowledgebase or Locuslink.

According to some embodiments of the present invention, variants of this cluster according to the present invention (amino acid and/or nucleic acid sequences of HSFLT) may optionally have one or more of the following utilities, as described below. It should be noted that these utilities are optionally and preferably suitable for human and non-human animals as subjects, except where otherwise noted.

A non-limiting example of such a diagnostic utility is detection of various cancer tumors. Vascular endothelial growth factor (VEGF) levels are associated with increased angiogenesis and aggressive tumor growth. In addition, it may serve as a marker for the early detection of coronary artery disease (CAD): experimental data show abnormal angiogenesis (VEGF and sFlt-1) in the patients with CAD.

Placental Growth Factor (HSPLGF), a member of the vascular endothelial growth factor (VEGF) family, competes with VEGF for binding to VEGF Receptor-1 (VEGFR1) (Am J Physiol Heart Circ Physiol. Apr. 24, 2003). Another non-limiting example of diagnostic utility of one or more HSFLT variants according to the present invention may optionally be related to one or more of the utilities of the HSPLGF placental growth factor, described herein (see the "Table of Utilities for Variants of HSPLGF, related to placental growth factor", herein). Therefore, variants of HSFLT cluster according to the present invention (amino acid and/or nucleic acid sequences of HSFLT) could be used as molecular marker for conditions including but not limited to the following: inflammation, pathological angiogenesis, monocyte recruitment that underlie chronic inflammatory disease.

Another non-limiting example of the utility of the variants of HSFLT cluster according to the present invention (amino acid and/or nucleic acid sequences of HSFLT) is using this marker as a surrogate marker for determining the efficacy of treatment for modulators, preferably inhibitors, of the VEGF-kinase ligand/receptor signaling system, which plays a key role in vascular development and regulation of vascular permeability. Blocking this system may be used to block angiogenesis, for example for treating cancer. The system may also optionally be modulated for treating cardiovascular conditions, peripheral vascular disease; ulcers; and ischaemia. This marker could also be used as a surrogate marker for determining the efficacy of treatment for modulators of the above conditions. Its suitability for treatment of the above conditions was described in PCT Application No. WO 05/072340 and hence is presence is clearly related to the mechanism of action of the above system in the body.

As noted above, cluster HSFLT features 15 transcript(s), which were listed in Table 6 above. These transcript(s) encode for protein(s) which are variant(s) of protein Vascular endothelial growth factor receptor 1 precursor. A description of each variant protein according to the present invention is provided as follows:

Variant protein HSFLT_P6 (SEQ ID NO:16) according to the present invention has an amino acid sequence as provided in the sequence listing; and is encoded by transcript(s)

HSFLT_T9 (SEQ ID NO:3). An alignment is provided with respect to the known protein (Vascular endothelial growth factor receptor 1 precursor) in the alignment table on the attached CD-ROM.

A brief description of the relationship of the variant protein according to the present invention to each such aligned protein is as follows:

1. Comparison report between HSFLT_P6 (SEQ ID NO:16) and VGR1_HUMAN_V1 (SEQ ID NO: 575):

A. An isolated chimeric polypeptide as set forth in HSFLT_P6 (SEQ ID NO:16), comprising a first amino acid sequence being at least 70%, optionally at least 80%, preferably at least 85%, more preferably at least 90% and most preferably at least 95%, homologous to a polypeptide having the sequence MTAP (SEQ ID NO: 459) corresponding to amino acids 1-4 of HSFLT_P6 (SEQ ID NO:16), and a second amino acid sequence being at least 90% homologous to FPLDTLIPDGKRIIWDSRKGFIIS-NATYKEIGLLTCEATVNGHLYKTNYLTH-RQTNTIIDVQISTPRPVKLLRGHTL VLNCTATTPLN-TRVQMTWSYPDEKNKRASVRRRIDQSNSHANIFYS-VLTIDKMQNKDKGLYTCRVRSGPSFKS VNTSVHIYD-KAFITVKHRKQQV-
LETVAGKRSYRLSMKVKAFPSPEV-
VWLKDGLPATEKSARYLTRGYSLIIKD VTEEDAGNYTILLSIKQSNVFKNL-
TATLIVNVKPQIYEKAVSSFPDPALY-
PLGSRQILTCTAYGIPQPTIKWFWHP CNHNH-SEARCDFCSNNEESFILDADSNMGNRIESITQRMAII-EGKNKMASTLVVADSRISGIYICIASNKVGTVGR NIS-FYITDVPNGFHVNLEKMPTEG-
EDLKLSCTVNKFLYRDVTWILLRTVN-
NRTMHYSISKQKMAITKEHSITLNL
TIMNVSLQDSGTYACRARNVYTGEE-
ILQKKEITIRDQEAPYLLRNLS-
DHTVAISSSTTLDCHANGVPEPQITWFK NNH-KIQQEPGIILGPGSSTLFIERVTEEDEGVYHCKATNQ-KGSVESSAYLTVQGTSDKSNLELITLTCTCVAATLF WLLLTLFIRKMKRSSSEIKTDYLSIIMD-
PDEVPLDEQCERLPYDASKWEFAR-
ERLKLGKSLGRGAFGKVVQASA FGIKKSPT-CRTVAVKMLKEGATASEYKALMTELKILTHIGHHLN-VVNLLGACTKQGGPLMVIVEYCKYGNLSN YLK-SKRDLFFLNKDAALHMEPKKEKMEP-
GLEQGKKPRLDSVTSSESFASSGFQEDK-
SLSDVEEEEDSDGFYKEP
ITMEDLISYSFQVARGMEFLSSRKCI-
HRDLAARNILLSENNVVKICDF-
GLARDIYKNPDYVRKGDTRLPLKWMA PESIFD-KIYSTKSDVWSYGVLLWEIFSLGGSPYPGVQMDED-FCSRLREGMRMRAPEYSTPEIYQIMLDCWHRDP KERPRFAELVEKLGDLLQAN-
VQQDGKDYIPINAILTGNSGFTYSTPAF-
SEDFFKESISAPKFNSGSSDDVRYVNA FKFMSLERIK-TFEELLPNATSMFDDYQGDSSTLLASPMLKRFTWTD-SKPKASLKIDLRVTSKSKESGLSDVSRPS FCHSSCGH-VSEGKRRFTYDHAELERKIACCSPPP-
DYNSVVLYSTPPI corresponding to amino acids 172-1338 of VGR1_HUMAN_V1 (SEQ ID NO: 575), which also corresponds to amino acids 5-1171 of HSFLT_P6 (SEQ ID NO:16), wherein said first amino acid sequence and second amino acid sequence are contiguous and in a sequential order.

B. An isolated polypeptide encoding for a head of HSFLT_P6 (SEQ ID NO:16), comprising a polypeptide being at least 70%, optionally at least about 80%, preferably at least about 85%, more preferably at least about 90% and most preferably at least about 95% homologous to the sequence MTAP (SEQ ID NO: 459) of HSFLT_P6 (SEQ ID NO:16).

It should be noted that the known protein sequences VGR1_HUMAN (SEQ ID NO: 359) and NP_002010 (SEQ ID NO: 531) have one or more changes than the sequence for VGR1_HUMAN_V1 (SEQ ID NO: 575). These changes were previously known to occur and are listed in table 9.

TABLE 9

| Changes to VGR1_HUMAN_V1 (SEQ ID NO: 575) | |
|---|---|
| SNP position on amino acid sequence | Type of change |
| 779 | conflict |

3. Comparison report between HSFLT_P6 (SEQ ID NO:16) and P17948-2 (SEQ ID NO:360):

A. An isolated chimeric polypeptide as set forth in HSFLT_P6 (SEQ ID NO:16), comprising a first amino acid sequence being at least 70%, optionally at least 80%, preferably at least 85%, more preferably at least 90% and most preferably at least 95%, homologous to a polypeptide having the sequence MTAP (SEQ ID NO: 459) corresponding to amino acids 1-4 of HSFLT_P6 (SEQ ID NO:16), a second amino acid sequence being at least 90% homologous to FPLDTLIPDGKRIIWDSRKGFIIS-
NATYKEIGLLTCEATVNGHLYKTNYLTH-
RQTNTIIDVQISTPRPVKLLRGHTL VLNCTATTPLN-TRVQMTWSYPDEKNKRASVRRRIDQSNSHANIFYS-VLTIDKMQNKDKGLYTCRVRSGPSFKS VNTSVHIYD-KAFITVKHRKQQV-
LETVAGKRSYRLSMKVKAFPSPEV-
VWLKDGLPATEKSARYLTRGYSLIIKD VTEEDAGNYTILLSIKQSNVFKNL-
TATLIVNVKPQIYEKAVSSFPDPALY-
PLGSRQILTCTAYGIPQPTIKWFWHP CNHNH-SEARCDFCSNNEESFILDADSNMGNRIESITQRMAII-EGKNKMASTLVVADSRISGIYICIASNKVGTVGR NIS-FYITDVPNGFHVNLEKMPTEG-
EDLKLSCTVNKFLYRDVTWILLRTVN-
NRTMHYSISKQKMAITKEHSITLNL
TIMNVSLQDSGTYACRARNVYTGEEILQKKEITIR corresponding to amino acids 172-656 of P17948-2 (SEQ ID NO:360), which also corresponds to amino acids 5-489 of HSFLT_P6 (SEQ ID NO:16), and a third amino acid sequence being at least 70%, optionally at least 80%, preferably at least 85%, more preferably at least 90% and most preferably at least 95% homologous to a polypeptide having the sequence DQEAPYLLRNLSDHTVAISSSTTLD-CHANGVPEPQITWFKNNHKIQQEPGI-
ILGPGSSTLFIERVTEEDEGVYHCK ATNQKGSVES-SAYLTVQGTSDKSNLELITLTCTCVAATLFWLLLTLFI-RKMKRSSSEIKTDYLSIIMDPDEVPLDE QCERLPY-DASKWEFARERLKLGKSLGRGAFGKV-
VQASAFGIKKSPTCRTVAVKMLKEGATA-
SEYKALMTELK
ILTHIGHHLNVVNLLGACTKQGGPLM-
VIVEYCKYGNLSNYLKSKRDLF-
FLNKDAALHMEPKKEKMEPGLEQG KKPRLDSVTSS-ESFASSGFQEDKSLSDVEEEEDSDGFYKEPITMEDLI-SYSFQVARGMEFLSSRKCIHRDLAARNI LLSENNV-VKICDFGLARDIYKNPDYVRKGDTRL-
PLKWMAPESIFDKIYSTKSDVWSYGVLL-
WEIFSLGGSPYPG
VQMDEDFCSRLREGMRMRAPEYSTPEIY- QIMLDCWHRDPKERPRFAELVEKLGDLLQANVQQDGKDYIPINAI LTGNSGFTYSTPAFSEDFFKESISAPKFNSGSSDDVRYVNAFKFMSLERIKTFEELLPNATSMFDDYQGDSSTLL ASPMLKRFTWTDSKPKASLKIDLRVTSKSKESGLSDVSRPSFCHSSCGHVSEGKRRFTYDHAELERKIACCSPPP DYNSVVLYSTPPI (SEQ ID NO: 460) corresponding to amino acids 490-1171 of HSFLT_P6 (SEQ ID NO:16), wherein said first amino acid sequence, second amino acid sequence and third amino acid sequence are contiguous and in a sequential order.

B. An isolated polypeptide encoding for a head of HSFLT_P6 (SEQ ID NO:16), comprising a polypeptide being at least 70%, optionally at least about 80%, preferably at least about 85%, more preferably at least about 90% and most preferably at least about 95% homologous to the sequence MTAP (SEQ ID NO: 459) of HSFLT_P6 (SEQ ID NO:16).

C. An isolated polypeptide encoding for an edge portion of HSFLT_P6 (SEQ ID NO:16), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPGIILGPGSSTLFIERVTEEDEGVYHCK ATNQKGSVESSAYLTVQGTSDKSNLELITLTCTCVAATLFWLLLTLFIRKMKRSSSEIKTDYLSIIMDPDEVPLDE QCERLPYDASKWEFARERLKLGKSLGRGAFGKVVQASAFGIKKSPTCRTVAVKMLKEGATASEYKALMTELK ILTHIGHHLNVVNLLGACTKQGGPLMVIVEYCKYGNLSNYLKSKRDLFFLNKDAALHMEPKKEKMEPGLEQG KKPRLDSVTSSESFASSGFQEDKSLSDVEEEEDSDGFYKEPITMEDLISYSFQVARGMEFLSSRKCIHRDLAARNI LLSENNVVKICDFGLARDIYKNPDYVRKGDTRLPLKWMAPESIFDKIYSTKSDVWSYGVLLWEIFSLGGSPYPG VQMDEDFCSRLREGMRMRAPEYSTPEIYQIMLDCWHRDPKERPRFAELVEKLGDLLQANVQQDGKDYIPINAI LTGNSGFTYSTPAFSEDFFKESISAPKFNSGSSDDVRYVNAFKFMSLERIKTFEELLPNATSMFDDYQGDSSTLL ASPMLKRFTWTDSKPKASLKIDLRVTSKSKESGLSDVSRPSFCHSSCGHVSEGKRRFTYDHAELERKIACCSPPP DYNSVVLYSTPPI (SEQ ID NO: 460) of HSFLT_P6 (SEQ ID NO:16).

The location of the variant protein was determined via the use of a number of different software programs and analyses, as described and including analyses from SignalP and other specialized programs.

In some embodiments of the invention, the variant protein is located in or in association with the cell membrane.

Variant protein HSFLT_P6 (SEQ ID NO:16) also has the following non-silent SNPs (Single Nucleotide Polymorphisms) as listed in Table 10, (lists the position(s) within the sequence and the alternative amino acid(s); the presence of known SNPs in variant protein HSFLT_P6 (SEQ ID NO:16) sequence provides support for the deduced sequence of this variant protein according to the present invention).

TABLE 10

Amino acid mutations

| SNP position(s) on amino acid sequence | Alternative amino acid(s) |
| --- | --- |
| 83 | L -> P |
| 117 | Q -> R |

TABLE 10-continued

Amino acid mutations

| SNP position(s) on amino acid sequence | Alternative amino acid(s) |
| --- | --- |
| 176 | V -> A |
| 227 | D -> G |
| 593 | I -> V |
| 680 | F -> S |

The glycosylation sites of variant protein HSFLT_P6 (SEQ ID NO:16), as compared to the known protein Vascular endothelial growth factor receptor 1 precursor, are described in Table 11 (given according to their position(s) on the amino acid sequence in the first column; the second column indicates whether the glycosylation site is present in the variant protein; and the last column indicates whether the position is different on the variant protein).

TABLE 11

Glycosylation site(s)

| Position(s) on known amino acid sequence | Present in variant protein? | Position(s) on variant protein |
| --- | --- | --- |
| 29 | Yes | 29 |
| 84 | Yes | 84 |
| 100 | No | |
| 156 | Yes | 156 |
| 164 | No | |
| 235 | Yes | 235 |
| 250 | Yes | 250 |
| 307 | Yes | 307 |
| 380 | Yes | 380 |
| 430 | Yes | 430 |
| 453 | Yes | 453 |
| 458 | Yes | 458 |
| 499 | Yes | 499 |

The phosphorylation sites of variant protein HSFLT_P6 (SEQ ID NO:16), as compared to the known protein, are described in Table 12 (given according to their position(s) on the amino acid sequence in the first column; the second column indicates whether the phosphorylation site is present in the variant protein; and the last column indicates whether the position is different on the variant protein).

TABLE 12

Phosphorylation site(s)

| Position(s) on known amino acid sequence | Present in variant protein? | Position(s) on variant protein |
| --- | --- | --- |
| 886 | Yes | 886 |
| 1002 | Yes | 1002 |
| 1046 | Yes | 1046 |
| 1075 | Yes | 1075 |
| 1160 | Yes | 1160 |
| 1166 | Yes | 1166 |

The variant protein has the following domains, as determined by using InterPro. The domains are described in Table 13:

TABLE 13

InterPro domain(s)

| Domain description | Analysis type | Position(s) on protein |
|---|---|---|
| Protein kinase | BlastProDom | 661-760, 826-992 |
| Vascular endothelial growth factor receptor 1, VEGFR1 | FPrintScan | 17-27, 75-87, 223-240, 281-295 |
| Vascular endothelial growth factor receptor 1, VEGFR1 | FPrintScan | 57-80, 106-123, 183-203, 208-222 |
| Immunoglobulin-like | HMMPfam | 78-146, 403-471, 508-566 |
| Protein kinase | HMMPfam | 660-987 |
| Tyrosine protein kinase | HMMSmart | 660-987 |
| Serine | HMMSmart | 660-991 |
| Immunoglobulin V-type | HMMSmart | 80-146, 405-471 |
| Immunoglobulin C2 type | HMMSmart | 76-151, 181-245, 401-476, 506-571 |
| Immunoglobulin subtype | HMMSmart | 70-162, 177-258, 272-386, 395-491, 500-582 |
| Protein kinase | ProfileScan | 660-991 |
| Immunoglobulin-like | ProfileScan | 63-160, 182-237, 261-386, 389-487, 494-580 |
| Protein kinase | ScanRegExp | 666-694 |
| Tyrosine protein kinase, active site | ScanRegExp | 851-863 |
| Receptor tyrosine kinase, class III | ScanRegExp | 719-732 |

Variant protein HSFLT_P6 (SEQ ID NO:16) is encoded by the following transcript(s): HSFLT_T9 (SEQ ID NO:3), for which the coding portion begins at position 1113 and ends at position 4625. The transcript also has the following SNPs as listed in Table 14 (given according to their position on the nucleotide sequence, with the alternative nucleic acid listed; the last column indicates whether the SNP is known or not; the presence of known SNPs in variant protein HSFLT_P6 (SEQ ID NO:16) sequence provides support for the deduced sequence of this variant protein according to the present invention).

TABLE 14

Nucleic acid SNPs

| Polymorphism: | Position(s) on nucleotide sequence |
|---|---|
| T -> C | 1360; 1639; 3151; 3815; 4250 |
| A -> G | 1462; 1622; 1792; 2889; 3683; 5718; 7237 |
| T -> G | 6143; 6148; 7266 |
| C -> T | 1830; 4975 |
| G -> A | 2315 |
| C -> A | 3362 |
| T -> | 4774 |
| G -> T | 5896 |
| A -> C | 6984 |

In one embodiment, a variant protein HSFLT_P7 according to the present invention has an amino acid sequence as set forth in (SEQ ID NO:17). In one embodiment, it is encoded by a p HSFLT_T10 polynucleotide (SEQ ID NO:4), and an alignment of the variant to the known protein (Vascular endothelial growth factor receptor 1 precursor) is presented in the alignment table on the attached CD-ROM. A brief description of the relationship of the variant protein according to the present invention to each such aligned protein is as follows:

1. Comparison report between HSFLT_P7 (SEQ ID NO:17) and VGR1_HUMAN_V1 (SEQ ID NO: 575):

A. An isolated chimeric polypeptide as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), and a second amino acid sequence being at least 90% homologous to FPLDTLIPDGKRIIWDSRKGFIISNATYKEIGLLT-CEATVNGHLYKTNYLTHRQTNTIIDVQISTPRP-VKLLRGHTL VLNCTATTPLNTRVQMTWSYPDE-KNKRASVRRRIDQSNSHANIFYSVLTIDKMQNKD-KGLYTCRVRSGPSFKS VNTSVHIYDKAFITVKH-RKQQVLETVAGKRSYRLSMKVKAFPSPEVVWL-KDGLPATEKSARYLTRGYSLIIKD VTEEDAGNYTILL-SIKQSNVFKNLTATLIVNVKPQIYEKAVSSFPD-PALYPLGSRQILTCTAYGIPQPTIKWFWHP CNHNH-SEARCDFCSNNEESFILDADSNMGNRIESITQR-MAIIEGKNKMASTLVVADSRISGIYICIASNKVGTVGR NISFYITDVPNGFHVNLEKMPTEGEDLKLSCTV-NKFLYRDVTWILLRTVNNRTMHYSISKQKMAIT-KEHSITLNL TIMNVSLQDSGTYACRARNVYTGEE-ILQKKEITIRDQEAPYLLRNLSDHTVAISSSTTLD-CHANGVPEPQITWFK NNHKIQQEPGIILGPGSSTLFI-ERVTEEDEGVYHCKATNQKGSVESSAYLTVQGTSD-KSNLELITLTCTCVAATLF WLLLTLFIRKMKRSSSEIK-TDYLSIIMDPDEVPLDEQCERLPYDASKWEFAR-ERLKLGKSLGRGAFGKVVQASA FGIKKSPTCRTVAV-KMLKEGATASEYKALMTELKILTHIGHHLNV-VNLLGACTKQGGPLMVIVEYCKYGNLSN YLK-SKRDLFFLNKDAALHMEPKKEKMEPGLEQGKKPRL-DSVTSSESFASSGFQEDKSLSDVEEEEDSDGFYKEP ITMEDLISYSFQVARGMEFLSSRKCIHRDLAA-RNILLSENNVVKICDFGLARDIYKNPDYVRK-GDTRLPLKWMA PESIFDKIYSTKSDVWSYGVLL-WEIFSLGGSPYPGVQMDEDFCSRLREGMRMRAP-EYSTPEIYQIMLDCWHRDP KERPRFAELVEK-LGDLLQANVQQDGKDYIPINAILTGNSGFTYSTP-AFSEDFFKESISAPKFNSGSSDDVRYVNA FKFMS-LERIKTFEELLPNATSMFDDYQGDSSTLLASPMLKR-FTWTDSKPKASLKIDLRVTSKSKESGLSDVSRPS FCH-SSCGHVSEGKRRFTYDHAELERKIACCSPPPDY-NSVVLYSTPPI corresponding to amino acids 172-1338 of VGR1_HUMAN_V1 (SEQ ID NO: 575), which also corresponds to amino acids 7-1173 of HSFLT_P7 (SEQ ID NO:17), wherein said first amino acid sequence and second amino acid sequence are contiguous and in a sequential order.

B. An isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

2. Comparison report between HSFLT_P7 (SEQ ID NO:17) and NP_002010_V1 (SEQ ID NO: 574):

A. An isolated chimeric polypeptide as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), and a second amino acid sequence being at least 90% homologous to FPLDTLIPDGKRIIWDSRKGFIISNATYKEIGLLTCEA-TVNGHLYKTNYLTHRQTNTIIDVQISTPRPVKLL-RGHTL VLNCTATTPLNTRVQMTWSYPDEKNKRA-SVRRRIDQSNSHANIFYSVLTIDKMQNKDKGLYT-CRVRSGPSFKS VNTSVHIYDKAFITVKHRKQQV-LETVAGKRSYRLSMKVKAFPSPEVVWLKDGLPA-TEKSARYLTRGYSLIIKD VTEEDAGNYTILLSIKQSN-VFKNLTATLIVNVKPQIYEKAVSSFPDPALYPLG-SRQILTCTAYGIPQPTIKWFWHP CNHNHSEARCDFC- SNNEESFILDADSNMGNRIESITQRMAIIEGKN- KMASTLVVADSRISGIYICIASNKVGTVGR NISFYITD- VPNGFHVNLEKMPTEGEDLKLSCTVNKFLYRDVT- WILLRTVNNRTMHYSISKQKMAITKEHSITLNL TIM- NVSLQDSGTYACRARNVYTGEEILQKKEITIRD- QEAPYLLRNLSDHTVAISSSTTLDCHANGVP- EPQITWFK NNHKIQQEPGIILGPGSSTLFIERVTEE- DEGVYHCKATNQKGSVESSAYLTVQGTSDKSNLE- LITLTCTCVAATLF WLLLTLFIRKMKRSSSEIKTDYL- SIIMDPDEVPLDEQCERLPYDASKWEFARERLK- LGKSLGRGAFGKVVQASA FGIKKSPTCRTVAVKM- LKEGATASEYKALMTELKILTHIGHHLNVVNLL- GACTKQGGPLMVIVEYCKYGNLSN YLKSKRDLF- FLNKDAALHMEPKKEKMEPGLEQGKKPRL- DSVTSSESFASSGFQEDKSLSDVEEEEDSDGFYKEP ITMEDLISYSFQVARGMEFLSSRKCIHRDLAARN- ILLSENNVVKICDFGLARDIYKNPDYVRKGDTRL- PLKWMA PESIFDKIYSTKSDVWSYGVLLWEIFS- LGGSPYPGVQMDEDFCSRLREGMRMRAPEYSTP- EIYQIMLDCWHRDP KERPRFAELVEKLGDLLQAN- VQQDGKDYIPINAILTGNSGFTYSTPAFSEDFFKE- SISAPKFNSGSSDDVRYVNA FKFMSLERIKTFEELLP- NATSMFDDYQGDSSTLLASPMLKRFTWTDSKPKA- SLKIDLRVTSKSKESGLSDVSRPS FCHSSCGHVSEG- KRRFTYDHAELERKIACCSPPPDYNSVVLYSTPPI corresponding to amino acids 172-1338 of NP_002010_V1 (SEQ ID NO: 574), which also corresponds to amino acids 7-1173 of HSFLT_P7 (SEQ ID NO:17), wherein said first amino acid sequence and second amino acid sequence are contiguous and in a sequential order.

B. An isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

3. Comparison report between HSFLT_P7 (SEQ ID NO:17) and P17948-2 (SEQ ID NO:360):

A. An isolated chimeric polypeptide as set forth in HSFLT_P7 (SEQ ID NO:17), comprising a first amino acid sequence being at least 70%, optionally at least 80%, preferably at least 85%, more preferably at least 90% and most preferably at least 95%, homologous to a polypeptide having the sequence MPLPFQ (SEQ ID NO: 576) corresponding to amino acids 1-6 of HSFLT_P7 (SEQ ID NO:17), a second amino acid sequence being at least 90% homologous to FPLDTLIPDGKRIIWDSRKGFIISNATYKEIGLLT- CEATVNGHLYKTNYLTHRQTNTIIDVQISTPRPVKLL- RGHTL VLNCTATTPLNTRVQMTWSYPDE- KNKRASVRRRIDQSNSHANIFYSVLTIDKMQNK- DKGLYTCRVRSGPSFKS VNTSVHIYDKAFITVKH- RKQQVLETVAGKRSYRLSMKVKAFPSPEVVWLK- DGLPATEKSARYLTRGYSLIIKD VTEEDAGNY- TILLSIKQSNVFKNLTATLIVNVKPQIYEKAVSSF- PDPALYPLGSRQILTCTAYGIPQPTIKWFWHP CNHNH- SEARCDFCSNNEESFILDADSNMGNRIESITQRM- AIIEGKNKMASTLVVADSRISGIYICIASNKVGTVGR NISFYITDVPNGFHVNLEKMPTEGEDLKLSCTV- NKFLYRDVTWILLRTVNNRTMHYSISKQKMAITK- EHSITLNL TIMNVSLQDSGTYACRARNVYTGEE- ILQKKEITIR corresponding to amino acids 172-656 of P17948-2 (SEQ ID NO:360), which also corresponds to amino acids 7-491 of HSFLT_P7 (SEQ ID NO:17), and a third amino acid sequence being at least 70%, optionally at least 80%, preferably at least 85%, more preferably at least 90% and most preferably at least 95% homologous to a polypeptide having the sequence DQEAPYLLRNLS- DHTVAISSSTTLDCHANGVPEPQITWFKNNHKIQ- QEPGIILGPGSSTLFIERVTEEDEGVYHCK ATNQKGS- VESSAYLTVQGTSDKSNLELITLTCTCVAATLFWLL- LTLFIRKMKRSSSEIKTDYLSIIMDPDEVPLDE QCER- LPYDASKWEFARERLKLGKSLGRGAFGKVVQASA- FGIKKSPTCRTVAVKMLKEGATASEYKALMTELK ILTHIGHHLNVVNLLGACTKQGGPLMVIVEYCK- YGNLSNYLKSKRDLFFLNKDAALHMEPKKEKM- EPGLEQG KKPRLDSVTSSESFASSGFQEDKSLSD- VEEEEDSDGFYKEPITMEDLISYSFQVARGMEFLS- SRKCIHRDLAARNI LLSENNVVKICDFGLARDIYKN- PDYVRKGDTRLPLKWMAPESIFDKIYSTKSDVWSY- GVLLWEIFSLGGSPYPG VQMDEDFCSRLREGMRM- RAPEYSTPEIYQIMLDCWHRDPKERPRFAELVEKL- GDLLQANVQQDGKDYIPINAI LTGNSGFTYSTPAF- SEDFFKESISAPKFNSGSSDDVRYVNAFKFMS- LERIKTFEELLPNATSMFDDYQGDSSTLL ASPM- LKRFTWTDSKPKASLKIDLRVTSKSKESGLSDVS- RPSFCHSSCGHVSEGKRRFTYDHAELERKIACCSPPP DYNSVVLYSTPPI (SEQ ID NO: 460) corresponding to amino acids 492-1173 of HSFLT_P7 (SEQ ID NO:17), wherein said first amino acid sequence, second amino acid sequence and third amino acid sequence are contiguous and in a sequential order.

B. An isolated polypeptide encoding for a head of HSFLT_P7 (SEQ ID NO:17), comprising a polypeptide being at least 70%, optionally at least about 80%, preferably at least about 85%, more preferably at least about 90% and most preferably at least about 95% homologous to the sequence MPLPFQ (SEQ ID NO: 576) of HSFLT_P7 (SEQ ID NO:17).

C. An isolated polypeptide encoding for an edge portion of HSFLT_P7 (SEQ ID NO:17), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLD- CHANGVPEPQITWFKNNHKIQQEPGIILGPGSSTL- FIERVTEEDEGVYHCK ATNQKGSVESSAYLTVQGTS- DKSNLELITLTCTCVAATLFWLLLTLFIRKMKRSSSEI- KTDYLSIIMDPDEVPLDE QCERLPYDASKWEFAR- ERLKLGKSLGRGAFGKVVQASAFGIKKSPTCRT- VAVKMLKEGATASEYKALMTELK ILTHIGHHLNV- VNLLGACTKQGGPLMVIVEYCKYGNLSNYLKSKRD- LFFLNKDAALHMEPKKEKMEPGLEQG KKPRLDS- VTSSESFASSGFQEDKSLSDVEEEEDSDGFYKEPIT- MEDLISYSFQVARGMEFLSSRKCIHRDLAARNI LLSE- NNVVKICDFGLARDIYKNPDYVRKGDTRLPLKWMA- PESIFDKIYSTKSDVWSYGVLLWEIFSLGGSPYPG VQMDEDFCSRLREGMRMRAPEYSTPEIYQIMLDCW- HRDPKERPRFAELVEKLGDLLQANVQQDGKD- YIPINAI LTGNSGFTYSTPAFSEDFFKESISAPKFNS- GSSDDVRYVNAFKFMSLERIKTFEELLPNATSMFDD- YQGDSSTLL ASPMLKRFTWTDSKPKASLKIDL- RVTSKSKESGLSDVSRPSFCHSSCGHVSEGKRRFTY- DHAELERKIACCSPPP DYNSVVLYSTPPI (SEQ ID NO: 460) of HSFLT_P7 (SEQ ID NO:17).

The location of the variant protein was determined according to results from a number of different software programs and analyses, including analyses from SignalP and other specialized programs. The variant protein is membrane.

Variant protein HSFLT_P7 (SEQ ID NO:17) also has the following non-silent SNPs (Single Nucleotide Polymorphisms) as listed in Table 15, (given according to their position(s) on the amino acid sequence, with the alternative amino acid(s) listed; the presence of known SNPs in variant protein HSFLT_P7 (SEQ ID NO:17) sequence provides support for the deduced sequence of this variant protein according to the present invention).

TABLE 15

Amino acid mutations

| SNP position(s) on amino acid sequence | Alternative amino acid(s) |
|---|---|
| 85 | L -> P |
| 119 | Q -> R |
| 178 | V -> A |
| 229 | D -> G |
| 595 | I -> V |
| 682 | F -> S |

The glycosylation sites of variant protein HSFLT_P7 (SEQ ID NO:17), as compared to the known protein Vascular endothelial growth factor receptor 1 precursor, are described in Table 16 (given according to their position(s) on the amino acid sequence in the first column; the second column indicates whether the glycosylation site is present in the variant protein; and the last column indicates whether the position is different on the variant protein).

TABLE 16

Glycosylation site(s)

| Position(s) on known amino acid sequence | Present in variant protein? | Position(s) on variant protein |
|---|---|---|
| 31 | Yes | 31 |
| 86 | Yes | 86 |
| 100 | No | |
| 158 | Yes | 158 |
| 164 | No | |
| 237 | Yes | 237 |
| 252 | Yes | 252 |
| 309 | Yes | 309 |
| 382 | Yes | 382 |
| 432 | Yes | 432 |
| 455 | Yes | 455 |
| 460 | Yes | 460 |
| 501 | Yes | 501 |

The phosphorylation sites of variant protein HSFLT_P7 (SEQ ID NO:17), as compared to the known protein, are described in Table 17 (given according to their position(s) on the amino acid sequence in the first column; the second column indicates whether the phosphorylation site is present in the variant protein; and the last column indicates whether the position is different on the variant protein).

TABLE 17

Phosphorylation site(s)

| Position(s) on known amino acid sequence | Presnet in variant protein? | Position(s) on variant protein |
|---|---|---|
| 888 | Yes | 888 |
| 1004 | Yes | 1004 |
| 1048 | Yes | 1048 |
| 1077 | Yes | 1077 |
| 1162 | Yes | 1162 |
| 1168 | Yes | 1168 |

The variant protein has the following domains, as determined by using InterPro. The domains are described in Table 18:

TABLE 18

InterPro domain(s)

| Domain description | Analysis type | Position(s) on protein |
|---|---|---|
| Protein kinase | BlastProDom | 663-762, 828-994 |
| Vascular endothelial growth factor receptor, VEGFR | FPrintScan | 19-29, 77-89, 225-242, 283-297 |
| Vascular endothelial growth factor receptor 1, VEGFR1 | FPrintScan | 59-82, 108-125, 185-205, 210-224 |
| Immunoglobulin-like | HMMPfam | 80-148, 405-473, 510-568 |
| Protein kinase | HMMPfam | 662-989 |
| Tyrosine protein kinase | HMMSmart | 662-989 |
| Serine | HMMSmart | 662-993 |
| Immunoglobulin V-type | HMMSmart | 82-148, 407-473 |
| Immunoglobulin C2 type | HMMSmart | 78-153, 183-247, 403-478, 508-573 |
| Immunoglobulin subtype | HMMSmart | 72-164, 179-260, 274-388, 397-493, 502-584 |
| Protein kinase | ProfileScan | 662-993 |
| Immunoglobulin-like | ProfileScan | 65-162, 184-239, 263-388, 391-489, 496-582 |
| Protein kinase | ScanRegExp | 668-696 |
| Tyrosine protein kinase, active site | ScanRegExp | 853-865 |
| Receptor tyrosine kinase, class III | ScanRegExp | 721-734 |

Variant protein HSFLT_P7 (SEQ ID NO:17) is encoded by the following transcript(s): HSFLT_T10 (SEQ ID NO:4), for which the coding portion begins at position 448 and ends at position 3966. The transcript also has the following SNPs as listed in Table 19 (given according to their position on the nucleotide sequence, with the alternative nucleic acid listed; the presence of known SNPs in variant protein HSFLT_P7 (SEQ ID NO:17) sequence provides support for the deduced sequence of this variant protein according to the present invention).

TABLE 19

Nucleic acid SNPs

| Polymorphism | nucleotide position |
|---|---|
| T -> C | 701, 980, 2492, 3156, 3591 |
| A -> G | 803, 963, 1133, 2230, 3024, 5059, 6578 |
| T -> G | 5484, 5489, 6607 |
| C -> T | 1171, 4316 |
| G -> A | 1656 |
| C -> A | 2703 |
| G -> T | 5237 |
| A -> C | 6325 |
| T -> | 4115 |

In some embodiments, HSFLT_P10 of the present invention has an amino acid sequence homologous to or as set forth in SEQ ID NO:18, and may be encoded by transcript(s) HSFLT_T13 (SEQ ID NO:5). An alignment of HSFLT_P10 to known proteinvascular endothelial growth factor receptor 1 precursor is provided in the alignment table on the attached CD-ROM. A brief description of the relationship of the variant protein according to the present invention to each such aligned protein is as follows:

1. Comparison report between HSFLT_P10 (SEQ ID NO:18) and VGR1_HUMAN (SEQ ID NO: 359):

A. An isolated chimeric polypeptide as set forth in HSFLT_P10 (SEQ ID NO:18), comprising a first amino acid sequence being at least 90% homologous to MVSYWDTGV-LLCALLSCLLLTGSSSGSKLKDPELSLKGTQHIMQA-GQTLHLQCRGEAAHKWSLPEMVSKESE RLSITK-SACGRNGKQFCSTLTLNTAQANHTGFYSCKYLAVP-TSKKKETESAIYIFISDTGRPFVEMYSEIPEIIHMT EGRELVIPCRVTSPNITVTLKKFPLDTLIPDGKR-
IIWDSRKGFIISNATYKEIGLLTCEATVNGHLYKTN-
YLTHRQT NTIIDVQISTPRPVKLLRGHTLVLNC-
TATTPLNTRVQMTWSYPDEKNKRASVRRRIDQS-
NSHANIFYSVLTIDKM QNKDKGLYTCRVRSGPSFKS-
VNTSVHIYDKAFITVKHRKQQVLETVAGKRSY-
RLSMKVKAFPSPEVVWLKDG LPATEKSARYLTR-
GYSLIIKDVTEEDAGNYTILLSIKQSNVFKNLTATLI-
VNVKPQIYEKAVSSFPDPALYPLGSR QILTCTAY-
GIPQPTIKWFWHPCNHNHSEARCDFCSNNEESFIL-
DADSNMGNRIESITQRMAIIEGKNKMASTLVV ADS-
RISGIYICIASNKVGTVGRNISFYITDVPNGFHVN-
LEKMPTEGEDLKLSCTVNKFLYRDVTWILLRTV-
NNRT MHYSISKQKMAITKEHSITLNLTIMNVS-
LQDSGTYACRARNVYTGEEILQKKEITIRDQEAPYL-
LRNLSDHTVAI SSSTTLDCHANGVPEPQITWFKNNH-
KIQQEP corresponding to amino acids 1-705 of
VGR1_HUMAN (SEQ ID NO: 359), which also corresponds
to amino acids 1-705 of HSFLT_P10 (SEQ ID NO:18), and a
second amino acid sequence being at least 70%, optionally at
least 80%, preferably at least 85%, more preferably at least
90% and most preferably at least 95% homologous to a
polypeptide having the sequence ELYTSTSPSSSSSS-
PLSSSSSSSSSSSS (SEQ ID NO: 462) corresponding to
amino acids 706-733 of HSFLT_P10 (SEQ ID NO:18),
wherein said first amino acid sequence and second amino acid
sequence are contiguous and in a sequential order.

B. An isolated polypeptide encoding for an edge portion of
HSFLT_P10 (SEQ ID NO:18), comprising an amino acid
sequence being at least 70%, optionally at least about 80%,
preferably at least about 85%, more preferably at least about
90% and most preferably at least about 95% homologous to
the sequence ELYTSTSPSSSSSSPLSSSSSSSSSSSS (SEQ
ID NO: 462) of HSFLT_P10 (SEQ ID NO:18).

2. Comparison report between HSFLT_P10 (SEQ ID NO:18)
and P17948-2 (SEQ ID NO:360):

A. An isolated chimeric polypeptide as set forth in
HSFLT_P10 (SEQ ID NO:18), comprising a first amino acid
sequence being at least 90% homologous to MVSYWDTGV-
LLCALLSCLLLTGSSSGSKLKDPELSLKGTQHIMQ-
AGQTLHLQCRGEAAHKWSLPEMVSKESE RLSITKS-
ACGRNGKQFCSTLTLNTAQANHTGFYSCKYLAV-
PTSKKKETESAIYIFISDTGRPFVEMYSEIPEIIHMT
EGRELVIPCRVTSPNITVTLKKFPLDTLIPDGK-
RIIWDSRKGFIISNATYKEIGLLTCEATVNGHL-
YKTNYLTHRQT NTIIDVQISTPRPVKLLRGHTLVLNC-
TATTPLNTRVQMTWSYPDEKNKRASVRRRIDQS-
NSHANIFYSVLTIDKM QNKDKGLYTCRVRSGPSFKS-
VNTSVHIYDKAFITVKHRKQQVLETVAGKRSYRL-
SMKVKAFPSPEVVWLKDG LPATEKSARYLTRGYSLI-
IKDVTEEDAGNYTILLSIKQSNVFKNLTATLIVNVKP-
QIYEKAVSSFPDPALYPLGSR QILTCTAYGIPQPTIKW-
FWHPCNHNHSEARCDFCSNNEESFILDADSNMGN-
RIESITQRMAIIEGKNKMASTLVV ADSRISGIYI-
CIASNKVGTVGRNISFYITDVPNGFHVNLEKMPTE-
GEDLKLSCTVNKFLYRDVTWILLRTVNNRT MHYS-
ISKQKMAITKEHSITLNLTIMNVSLQDSGTYAC-
RARNVYTGEEILQKKEITIR corresponding to amino
acids 1-656 of P17948-2 (SEQ ID NO:360), which also corresponds
to amino acids 1-656 of HSFLT_P10 (SEQ ID
NO:18), and a second amino acid sequence being at least
70%, optionally at least 80%, preferably at least 85%, more
preferably at least 90% and most preferably at least 95%
homologous to a polypeptide having the sequence DQEAPY-
LLRNLSDHTVAISSSTTLDCHANGVPEPQITWFK-
NNHKIQQEPELYTSTSPSSSSSSPLSSSSSSSSSSSS
(SEQ ID NO: 463) corresponding to amino acids 657-733 of
HSFLT_P10 (SEQ ID NO:18), wherein said first amino acid
sequence and second amino acid sequence are contiguous and
in a sequential order.

B. An isolated polypeptide encoding for an edge portion of
HSFLT_P10 (SEQ ID NO:18), comprising an amino acid
sequence being at least 70%, optionally at least about 80%,
preferably at least about 85%, more preferably at least about
90% and most preferably at least about 95% homologous to
the sequence DQEAPYLLRNLSDHTVAISSSTTLD-
CHANGVPEPQITWFKNNHKIQQEPELYTSTSPSSS-
SSSPLSSSSSSSSSSSS (SEQ ID NO: 463) of HSFLT_P10
(SEQ ID NO:18).

3. Comparison report between HSFLT_P10 (SEQ ID NO:18)
and NP_002010 (SEQ ID NO: 531):

A. An isolated chimeric polypeptide as set forth in
HSFLT_P10 (SEQ ID NO:18), comprising a first amino acid
sequence being at least 90% homologous to MVSYWDTGV-
LLCALLSCLLLTGSSSGSKLKDPELSLKGTQHIMQ-
AGQTLHLQCRGEAAHKWSLPEMVSKESE RLSITKS-
ACGRNGKQFCSTLTLNTAQANHTGFYSCKYLAVP-
TSKKKETESAIYIFISDTGRPFVEMYSEIPEIIHMT
EGRELVIPCRVTSPNITVTLKKFPLDTLIPDGKRII-
WDSRKGFIISNATYKEIGLLTCEATVNGHLYKTN-
YLTHRQT NTIIDVQISTPRPVKLLRGHTLVLNC-
TATTPLNTRVQMTWSYPDEKNKRASVRRRIDQSNS-
HANIFYSVLTIDKM QNKDKGLYTCRVRSGPSFKS-
VNTSVHIYDKAFITVKHRKQQVLETVAGKRSY-
RLSMKVKAFPSPEVVWLKDG LPATEKSARYLTR-
GYSLIIKDVTEEDAGNYTILLSIKQSNVFKNLTATL-
IVNVKPQIYEKAVSSFPDPALYPLGSR QILTCTAY-
GIPQPTIKWFWHPCNHNHSEARCDFCSNNEESFILD-
ADSNMGNRIESITQRMAIIEGKNKMASTLVV ADSR-
ISGIYICIASNKVGTVGRNISFYITDVPNGFHVNL-
EKMPTEGEDLKLSCTVNKFLYRDVTWILLRTVNNRT
MHYSISKQKMAITKEHSITLNLTIMNVSLQDSGT-
YACRARNVYTGEEILQKKEITIRDQEAPYLL-
RNLSDHTVAI SSSTTLDCHANGVPEPQITWFKNNH-
KIQQEP corresponding to amino acids 1-705 of NP_002010
(SEQ ID NO: 531), which also corresponds to amino acids
1-705 of HSFLT_P10 (SEQ ID NO:18), and a second amino
acid sequence being at least 70%, optionally at least 80%,
preferably at least 85%, more preferably at least 90% and
most preferably at least 95% homologous to a polypeptide
having the sequence ELYTSTSPSSSSSSPLSSSSSSSSSSSS
(SEQ ID NO: 462) corresponding to amino acids 706-733 of
HSFLT_P10 (SEQ ID NO:18), wherein said first amino acid
sequence and second amino acid sequence are contiguous and
in a sequential order.

B. An isolated polypeptide encoding for an edge portion of
HSFLT_P10 (SEQ ID NO:18), comprising an amino acid
sequence being at least 70%, optionally at least about 80%,
preferably at least about 85%, more preferably at least about
90% and most preferably at least about 95% homologous to
the sequence ELYTSTSPSSSSSSPLSSSSSSSSSSSS (SEQ
ID NO: 462) of HSFLT_P10 (SEQ ID NO:18).

The location of the variant protein was determined according
to results from a number of different software programs
and analyses, including analyses from SignalP and other specialized
programs. The variant protein is secreted.

Variant protein HSFLT_P10 (SEQ ID NO:18) also has the
following non-silent SNPs (Single Nucleotide Polymorphisms)
as listed in Table 20, (given according to their position(s)
on the amino acid sequence, with the alternative amino
acid(s) listed; the presence of known SNPs in variant protein
HSFLT_P10 (SEQ ID NO:18) sequence provides support for
the deduced sequence of this variant protein according to the
present invention).

TABLE 20

| Amino acid mutations | |
|---|---|
| SNP position(s) on amino acid sequence | Alternative amino acids |
| 250 | L -> P |
| 284 | Q -> R |
| 343 | V -> A |
| 394 | D -> G |

The glycosylation sites of variant protein HSFLT_P10 (SEQ ID NO:18), as compared to the known protein Vascular endothelial growth factor receptor 1 precursor, are described in Table 21 (given according to their position(s) on the amino acid sequence in the first column; the second column indicates whether the glycosylation site is present in the variant protein; and the last column indicates whether the position is different on the variant protein).

TABLE 21

| Glycosylation site(s) | | |
|---|---|---|
| Position(s) on known amino acid sequence | Present in variant protein? | Postion(s) on variant protien |
| 100 | Yes | 100 |
| 164 | Yes | 164 |
| 196 | Yes | 196 |
| 251 | Yes | 251 |
| 323 | Yes | 323 |
| 402 | Yes | 402 |
| 417 | Yes | 417 |
| 474 | Yes | 474 |
| 547 | Yes | 547 |
| 597 | Yes | 597 |
| 620 | Yes | 620 |
| 625 | Yes | 625 |
| 666 | Yes | 666 |

The phosphorylation sites of variant protein HSFLT_P10 (SEQ ID NO:18), as compared to the known protein, are described in Table 22 (given according to their position(s) on the amino acid sequence in the first column; the second column indicates whether the phosphorylation site is present in the variant protein; and the last column indicates whether the position is different on the variant protein).

TABLE 22

| Phosphorylation site(s) | | |
|---|---|---|
| Position(s) on known amino acid sequence | Present in variant protein? | Postion(s) on variant protien |
| 1053 | No | |
| 1169 | No | |
| 1213 | No | |
| 1242 | No | |
| 1327 | No | |
| 1333 | No | |

The variant protein has the following domains, as determined by using InterPro. The domains are described in Table 23:

TABLE 23

| InterPro domain(s) | | |
|---|---|---|
| Domain description | Analysis type | Position(s) on protein |
| Vascular endothelial growth factor receptor, VEGFR | FPrintScan | 89-107, 125-136, 184-194, 242-254, 390-407, 448-462 |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313, 570-638, 675-731 |
| Immunoglobulin V-type | HMMSmart | 247-313, 572-638 |
| Immunoglobulin C2 type | HMMSmart | 149-214, 243-318, 348-412, 568-643, 673-732 |
| Immunoglobulin subtype | HMMSmart | 38-129, 143-224, 237-329, 344-425, 439-553, 562-658 |
| Immunoglobulin-like | ProfileScan | 32-107, 230-327, 349-404, 428-553, 556-654, 661-733 |

Variant protein HSFLT_P10 (SEQ ID NO:18) is encoded by the following transcript(s): HSFLT_T13 (SEQ ID NO:5), for which the coding portion starts at position 315 and ends at position 2513. The transcript also has the following SNPs as listed in Table 24 (given according to their position on the nucleotide sequence, with the alternative nucleic acid listed; the presence of known SNPs in variant protein HSFLT_P10 (SEQ ID NO:18) sequence provides support for the deduced sequence of this variant protein according to the present invention).

TABLE 24

| Nucleic acid SNPs | |
|---|---|
| Polymorphism | SNP position(s) on nucleotide sequence |
| ->C | 823 |
| T -> C | 1063, 1342 |
| A -> G | 1165, 1325, 1495 |
| C -> T | 1533 |
| G -> A | 2018 |
| G -> T | 3301 |

Variant protein HSFLT_P11 (SEQ ID NO:19) according to the present invention has an amino acid sequence as given at the end of the application; it is encoded by transcript(s) HSFLT_T14 (SEQ ID NO:6). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P11 (SEQ ID NO:19) and VGR1_HUMAN (SEQ ID NO: 359):

A. An isolated chimeric polypeptide as set forth in a chimeric HSFLT_P11(SEQ ID NO:19) polypeptide comprising a first amino acid sequence being at least 90% homologous to MVSYWDTGVLLCALLSCLLLTGSSSGSKLKDPELSLKGTQHIMQAGQTLHLQCRGEAAHKWSLPEMVSKESE RLSITKSACGRNGKQFCSTLTLNTAQANHTGFYSCKYLAVPTSKKKETESAIYIFISDTGRPFVEMYSEIPEIIHMT EGRELVIPCRVTSPNITVTLKKFPLDTLIPDGKRIIWDSRKGFIISNATYKEIGLLTCEATVNGHLYKTNYLTHRQT NTIIDVQISTPRPVKLLRGHTLVLNCTATTPLNTRVQMTWSYPDEKNKRASVRRRIDQSNSHANIFYSVLTIDKM QNKDKGLYTCRVRSGPSFKSVNTSVHIYDKAFITVKHRKQQVLETVAGKRSYRLSMKVKAFPSPEVVWLKDG LPATEKSARYLTRGYSLIIKDVTEEDAGNYTILLSIKQSNVFKNLTATLIVNVKPQIYEKAVSSFPDPALYPLGSR QILTCTAYGIPQPTIKWFWHPCNHNHSEARCDFCSNNEESFILDADSNMGNRIESITQRMAIIEGKNKMASTLVV ADSRISGIYICIASNKVGTVGRNISFYITDVPNGFHVNLEKMPTEGEDLKLSCTVNKFLYRDVTWILLRTVNNRT MHYSISKQKMAITKEHSITLNLTIMNVSLQDSGTYACRARNVYTGEEILQKKEITIRDQEAPYLLRNLSDHTVAI SSSTTLDCHANGVPEPQITWFKNNHKIQQEPG corresponding to amino acids 1-706 of VGR1_HUMAN (SEQ ID NO: 359), which also corresponds to amino acids 1-706 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence SANTAVNKKTEI (SEQ ID NO: 464) corresponding to amino acids 707-718 of HSFLT_P11 (SEQ ID NO:19), wherein said first amino acid sequence and second amino acid sequence are contiguous and in a sequential order.

B. An isolated polypeptide encoding for an edge portion of HSFLT_P11 (SEQ ID NO:19), comprising an amino acid sequence being at least 70%, optionally at least about 80%, preferably at least about 85%, more preferably at least about 90% and most preferably at least about 95% homologous to the sequence SANTAVNKKTEI (SEQ ID NO: 464) of HSFLT_P11 (SEQ ID NO:19).

2. Comparison report between HSFLT_P11 (SEQ ID NO:19) and P17948-2 (SEQ ID NO:360):

A. An isolated chimeric polypeptide as set forth in HSFLT_P11 (SEQ ID NO:19), comprising a first amino acid sequence being at least 90% homologous to MVSYWDTGVLLCALLSCLLLTGSSSGSKLKDPELSLKGTQHIMQAGQTLHLQCRGEAAHKWSLPEMVSKESE RLSITKSACGRNGKQFCSTLTLNTAQANHTGFYSCKYLAVPTSKKKETESAIYIFISDTGRPFVEMYSEIPEIIHMT EGRELVIPCRVTSPNITVTLKKFPLDTLIPDGKRIIWDSRKGFIISNATYKEIGLLTCEATVNGHLYKTNYLTHRQT NTIIDVQISTPRPVKLLRGHTLVLNCTATTPLNTRVQMTWSYPDEKNKRASVRRRIDQSNSHANIFYSVLTIDKM QNKDKGLYTCRVRSGPSFKSVNTSVHIYDKAFITVKHRKQQVLETVAGKRSYRLSMKVKAFPSPEVVWLKDG LPATEKSARYLTRGYSLIIKDVTEEDAGNYTILLSIKQSNVFKNLTATLIVNVKPQIYEKAVSSFPDPALYPLGSR QILTCTAYGIPQPTIKWFWHPCNHNHSEARCDFCSNNEESFILDADSNMGNRIESITQRMAIIEGKNKMASTLVV ADSRISGIYICIASNKVGTVGRNISFYITDVPNGFHVNLEKMPTEGEDLKLSCTVNKFLYRDVTWILLRTVNNRT MHYSISKQKMAITKEHSITLNLTIMNVSLQDSGTYACRARNVYTGEEILQKKEITIR corresponding to amino acids 1-656 of P17948-2 (SEQ ID NO:360), which also corresponds to amino acids 1-656 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence DQEAPYLLRNLSDHTVAISSSTTLDCHANGVPEPQITWFKNNHKIQQEPGSANTAVNKKTEI (SEQ ID NO: 465) corresponding to amino acids 657-718 of HSFLT_P11 (SEQ ID NO:19), wherein said first amino acid sequence and second amino acid sequence are contiguous and in a sequential order.

B. An isolated polypeptide encoding for an edge portion of HSFLT_P11 (SEQ ID NO:19), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLDCHANGVPEPQITWFKNNHKIQQEPGSANTAVNKKTEI (SEQ ID NO: 465) of HSFLT_P11 (SEQ ID NO:19).

3. Comparison report between HSFLT_P11 (SEQ ID NO:19) and NP_002010 (SEQ ID NO: 531):

A. An isolated chimeric polypeptide as set forth in HSFLT_P11 (SEQ ID NO:19), comprising a first amino acid sequence being at least 90% homologous to MVSYWDTGVLLCALLSCLLLTGSSSGSKLKDPELSLKGTQHIMQAGQTLHLQCRGEAAHKWSLPEMVSKESE RLSITKSACGRNGKQFCSTLTLNTAQANHTGFYSCKYLAVPTSKKKETESAIYIFISDTGRPFVEMYSEIPEIIHMT EGRELVIPCRVTSPNITVTLKKFPLDTLIPDGKRIIWDSRKGFIISNATYKEIGLLTCEATVNGHLYKTNYLTHRQT NTIIDVQISTPRPVKLLRGHTLVLNCTATTPLNTRVQMTWSYPDEKNKRASVRRRIDQSNSHANIFYSVLTIDKM QNKDKGLYTCRVRSGPSFKSVNTSVHIYDKAFITVKHRKQQVLETVAGKRSYRLSMKVKAFPSPEVVWLKDG LPATEKSARYLTRGYSLIIKDVTEEDAGNYTILLSIKQSNVFKNLTATLIVNVKPQIYEKAVSSFPDPALYPLGSR QILTCTAYGIPQPTIKWFWHPCNHNHSEARCDFCSNNEESFILDADSNMGNRIESITQRMAIIEGKNKMASTLVV ADSRISGIYICIASNKVGTVGRNISFYITDVPNGFHVNLEKMPTEGEDLKLSCTVNKFLYRDVTWILLRTVNNRT MHYSISKQKMAITKEHSITLNLTIMNVSLQDSGTYACRARNVYTGEEILQKKEITIRDQEAPYLLRNLSDHTVAI SSSTTLDCHANGVPEPQITWFKNNHKIQQEPG corresponding to amino acids 1-706 of NP_002010 (SEQ ID NO: 531), which also corresponds to amino acids 1-706 of HSFLT_P11 (SEQ ID NO:19), and a second amino acid sequence being at least 70%, optionally at least 80%, preferably at least 85%, more preferably at least 90% and most preferably at least 95% homologous to a polypeptide having the sequence SANTAVNKKTEI (SEQ ID NO: 464) corresponding to amino acids 707-718 of HSFLT_P11 (SEQ ID NO:19), wherein said first amino acid sequence and second amino acid sequence are contiguous and in a sequential order.

B. An isolated polypeptide encoding for an edge portion of HSFLT_P11 (SEQ ID NO:19), comprising an amino acid sequence being at least 70%, optionally at least about 80%, preferably at least about 85%, more preferably at least about 90% and most preferably at least about 95% homologous to the sequence SANTAVNKKTEI (SEQ ID NO: 464) of HSFLT_P11 (SEQ ID NO:19).

The location of the variant protein was determined according to results from a number of different software programs and analyses, including analyses from SignalP and other specialized programs. The variant protein is secreted.

Variant protein HSFLT_P11 (SEQ ID NO:19) also has the following non-silent SNPs (Single Nucleotide Polymorphisms) as listed in Table 25, (given according to their position(s) on the amino acid sequence, with the alternative amino acid(s) listed; the presence of known SNPs in variant protein HSFLT_P11 (SEQ ID NO:19) sequence provides support for the deduced sequence of this variant protein according to the present invention).

TABLE 25

Amino acid mutations

| SNP position(s) on amino acid sequence | Alternative amino acid(s) |
|---|---|
| 250 | L -> P |
| 284 | Q -> R |
| 343 | V -> A |
| 394 | D -> G |

The glycosylation sites of variant protein HSFLT_P11 (SEQ ID NO:19), as compared to the known protein Vascular endothelial growth factor receptor 1 precursor, are described in Table 26 (given according to their position(s) on the amino acid sequence in the first column; the second column indicates whether the glycosylation site is present in the variant protein; and the last column indicates whether the position is different on the variant protein).

TABLE 26

Glycosylation site(s)

| Position(s) on known amino acid sequence | Present in variant protein? | Postion(s) on variant protien |
|---|---|---|
| 100 | Yes | 100 |
| 164 | Yes | 164 |
| 196 | Yes | 196 |
| 251 | Yes | 251 |
| 323 | Yes | 323 |
| 402 | Yes | 402 |

TABLE 26-continued

Glycosylation site(s)

| Position(s) on known amino acid sequence | Present in variant protein? | Postion(s) on variant protien |
|---|---|---|
| 417 | Yes | 417 |
| 474 | Yes | 474 |
| 547 | Yes | 547 |
| 597 | Yes | 597 |
| 620 | Yes | 620 |
| 625 | Yes | 625 |
| 666 | Yes | 666 |

The phosphorylation sites of variant protein HSFLT_P11 (SEQ ID NO:19), as compared to the known protein, are described in Table 27 (given according to their position(s) on the amino acid sequence in the first column; the second column indicates whether the phosphorylation site is present in the variant protein; and the last column indicates whether the position is different on the variant protein).

TABLE 27

Phosphorylation site(s)

| Position(s) on known amino acid sequence | Present in variant protein? |
|---|---|
| 1053 | No |
| 1169 | No |
| 1213 | No |
| 1242 | No |
| 1327 | No |
| 1333 | No |

The variant protein has the following domains, as determined by using InterPro. The domains are described in Table 28:

TABLE 28

InterPro domain(s)

| Domain description | Analysis type | Position(s) on protein |
|---|---|---|
| Vascular endothelial growth factor receptor, VEGFR | FPrintScan | 89-107, 125-136, 184-194, 242-254, 390-407, 448-462 |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313, 570-638 |
| Immunoglobulin V-type | HMMSmart | 247-313, 572-638 |
| Immunoglobulin C2 type | HMMSmart | 149-214, 243-318, 348-412, 568-643, 673-716 |
| Immunoglobulin subtype | HMMSmart | 38-129, 143-224, 237-329, 344-425, 439-553, 562-658 |
| Immunoglobulin-like | ProfileScan | 32-107, 230-327, 349-404, 428-553, 556-654, 661-718 |

Variant protein HSFLT_P11 (SEQ ID NO:19) is encoded by the following transcript(s): HSFLT_T14 (SEQ ID NO:6), for which the coding portion starts at position 315 and ends at position 2468. The transcript also has the following SNPs as listed in Table 29 (given according to their position on the nucleotide sequence, with the alternative nucleic acid listed; the presence of known SNPs in variant protein HSFLT_P11 (SEQ ID NO:19) sequence provides support for the deduced sequence of this variant protein according to the present invention).

TABLE 29

Nucleic acid SNPs

| Polymorphism | SNP position(s) on nucleotide sequence |
| --- | --- |
| -> C | 823 |
| T -> C | 1063, 1342 |
| A -> G | 1165, 1325, 1496 |
| C -> T | 1533 |
| G -> A | 2018 |

Variant protein HSFLT_P13 (SEQ ID NO:20) according to the present invention has an amino acid sequence as given at the end of the application; it is encoded by transcript(s) HSFLT_T17 (SEQ ID NO:7). An alignment is given to the known protein (Vascular endothelial growth factor receptor 1 precursor in the alignment table on the attached CD-ROM. A brief description of the relationship of the variant protein according to the present invention to each such aligned protein is as follows:

1. Comparison report between HSFLT_P13 (SEQ ID NO:20) and VGR1_HUMAN (SEQ ID NO: 359):

A. An isolated chimeric polypeptide as set forth in HSFLT_P13 (SEQ ID NO:20), comprising a first amino acid sequence being at least 90% homologous to MVSYWDTGV-LLCALLSCLLLTGSSSGSKLKDPELSLKGTQ-HIMQAGQTLHLQCRGEAAHKWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV-QISTPRPVKLLRGHTLVLNCTATTPLNTRVQMTWSY-PDEKNKRASVRRRIDQSNSHANIFYSVLTIDKM QNKDKGLYTCRVRSGPSFKSVNTSVHIY-DKAFITVKHRKQQV-LETVAGKRSYRLSMKVKAFPSPEVVWLKDG LPATEKSARYLTRGYSLIIKDVTEEDAG-NYTILLSIKQSNVFKNLTATLIVNVKP-QIYEKAVSSFPDPALYPLGSR QILTCTAYGIPQPTIKW-FWHPCNHNHSEARCDFCSNNEESFILDADSNMGNR-IESITQRMAIIEGKNKMASTLVV ADSRISGIYI-CIASNKVGTVGRNISFYITDVPNGFHVN-LEKMPTEGEDLKLSCTVNKFLYRD-VTWILLRTVNNRT MHYSISKQKMAITKEHSITLNLTIMNVS-LQDSGTYACRARNVYTGEE-ILQKKEITIRDQEAPYLLRNLSDHTVAI SSSTTLD-CHANGVPEPQITWFKNNHKIQQEPG corresponding to amino acids 1-706 of VGR1_HUMAN (SEQ ID NO: 359), which also corresponds to amino acids 1-706 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence KRLF-FLPFIISHLSSAPLSLNSPVTCFQYV (SEQ ID NO: 466) corresponding to amino acids 707-736 of HSFLT_P13 (SEQ ID NO:20), wherein said first amino acid sequence and second amino acid sequence are contiguous and in a sequential order.

B. An isolated polypeptide encoding for an edge portion of HSFLT_P13 (SEQ ID NO:20), comprising an amino acid sequence being at least 70%, optionally at least about 80%, preferably at least about 85%, more preferably at least about 90% and most preferably at least about 95% homologous to the sequence KRLFFLPFIISHLSSAPLSLNSPVTCFQYV (SEQ ID NO: 466) of HSFLT_P13 (SEQ ID NO:20).

2. Comparison report between HSFLT_P13 (SEQ ID NO:20) and P17948-2 (SEQ ID NO:360):

A. An isolated chimeric polypeptide as set forth in HSFLT_P13 (SEQ ID NO:20), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV-QISTPRPVKLLRGHTLVLNCTATTPLNTRVQMTWSY-PDEKNKRASVRRRIDQSNSHANIFYSVLTIDKM QNKDKGLYTCRVRSGPSFKSVNTSVHIY-DKAFITVKHRKQQV-LETVAGKRSYRLSMKVKAFPSPEVVWLKDG LPATEKSARYLTRGYSLIIKDVTEEDAG-NYTILLSIKQSNVFKNLTATLIVNVKP-QIYEKAVSSFPDPALYPLGSR QILTCTAYGIPQPTIKW-FWHPCNHNHSEARCDFCSNNEESFILDADSNMGNR-IESITQRMAIIEGKNKMASTLVV ADSRISGIYI-CIASNKVGTVGRNISFYITDVPNGFHVN-LEKMPTEGEDLKLSCTVNKFLYRD-VTWILLRTVNNRT MHYSISKQKMAITKEHSITLNLTIMNVS-LQDSGTYACRARNVYTGEEILQKKEITIR corresponding to amino acids 1-656 of P17948-2 (SEQ ID NO:360), which also corresponds to amino acids 1-656 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence DQEAPY-LLRNLSDHTVAISSSTTLDCHANGVPEP-QITWFKNNHKIQQEPGKRLFFLPFI-ISHLSSAPLSLNSPVTCF QYV (SEQ ID NO: 467) corresponding to amino acids 657-736 of HSFLT_P13 (SEQ ID NO:20), wherein said first amino acid sequence and second amino acid sequence are contiguous and in a sequential order.

B. An isolated polypeptide encoding for an edge portion of HSFLT_P13 (SEQ ID NO:20), comprising an amino acid sequence being at least 70%, optionally at least about 80%, preferably at least about 85%, more preferably at least about 90% and most preferably at least about 95% homologous to the sequence DQEAPYLLRNLSDHTVAISSSTTLD-CHANGVPEPQITWFKNNH-KIQQEPGKRLFFLPFIISHLSSAPLSLNSPVTCF QYV (SEQ ID NO: 467) of HSFLT_P13 (SEQ ID NO:20).

3. Comparison report between HSFLT_P13 (SEQ ID NO:20) and NP_002010 (SEQ ID NO: 531):

A. An isolated chimeric polypeptide as set forth in HSFLT_P13 (SEQ ID NO:20), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV- QISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSR QILTCTAYGIPQPTIKWFWHPCNHNHSEARCDFCSNNEESFILDADSNMGNRIESITQRMAIIEGKNKMASTLVV ADSRISGIYICIASNKVGTVGRNISFYITDVPNGFHVNLEKMPTEGEDLKLSCTVNKFLYRDVTWILLRTVNNRT MHYSISKQKMAITKEHSITLNLTIMNVSLQDSGTYACRARNVYTGEEILQKKEITIRDQEAPYLLRNLSDHTVAI SSSTTLDCHANGVPEPQITWFKNNHKIQQEPG corresponding to amino acids 1-706 of NP_002010 (SEQ ID NO: 531), which also corresponds to amino acids 1-706 of HSFLT_P13 (SEQ ID NO:20), and a second amino acid sequence being at least 70%, optionally at least 80%, preferably at least 85%, more preferably at least 90% and most preferably at least 95% homologous to a polypeptide having the sequence KRLFFLPFIISHLSSAPLSLNSPVTCFQYV (SEQ ID NO: 466) corresponding to amino acids 707-736 of HSFLT_P13 (SEQ ID NO:20), wherein said first amino acid sequence and second amino acid sequence are contiguous and in a sequential order.

B. An isolated polypeptide encoding for an edge portion of HSFLT_P13 (SEQ ID NO:20), comprising an amino acid sequence being at least 70%, optionally at least about 80%, preferably at least about 85%, more preferably at least about 90% and most preferably at least about 95% homologous to the sequence KRLFFLPFIISHLSSAPLSLNSPVTCFQYV (SEQ ID NO: 466) of HSFLT_P13 (SEQ ID NO:20).

The location of the variant protein was determined according to results from a number of different software programs and analyses, including analyses from SignalP and other specialized programs. The variant protein is secreted.

Variant protein HSFLT_P13 (SEQ ID NO:20) also has the following non-silent SNPs (Single Nucleotide Polymorphisms) as listed in Table 30, (given according to their position(s) on the amino acid sequence, with the alternative amino acid(s) listed; the presence of known SNPs in variant protein HSFLT_P13 (SEQ ID NO:20) sequence provides support for the deduced sequence of this variant protein according to the present invention).

TABLE 30

| Amino acid mutations | |
|---|---|
| SNP position(s) on amino acid sequence | Alternative amino acid(s) |
| 250 | L -> P |
| 284 | Q -> R |
| 343 | V -> A |
| 394 | D -> G |

The glycosylation sites of variant protein HSFLT_P13 (SEQ ID NO:20), as compared to the known protein Vascular endothelial growth factor receptor 1 precursor, are described in Table 31 (given according to their position(s) on the amino acid sequence in the first column; the second column indicates whether the glycosylation site is present in the variant protein; and the last column indicates whether the position is different on the variant protein).

TABLE 31

| Glycosylation site(s) | | |
|---|---|---|
| Position(s) on known amino acid sequence | Present in variant protein? | Position(s) on variant protien |
| 100 | Yes | 100 |
| 164 | Yes | 164 |
| 196 | Yes | 196 |
| 251 | Yes | 251 |
| 323 | Yes | 323 |
| 402 | Yes | 402 |
| 417 | Yes | 417 |
| 474 | Yes | 474 |
| 547 | Yes | 547 |
| 597 | Yes | 597 |
| 620 | Yes | 620 |
| 625 | Yes | 625 |
| 666 | Yes | 666 |

The phosphorylation sites of variant protein HSFLT_P13 (SEQ ID NO:20), as compared to the known protein, are described in Table 32 (given according to their position(s) on the amino acid sequence in the first column; the second column indicates whether the phosphorylation site is present in the variant protein; and the last column indicates whether the position is different on the variant protein).

TABLE 32

| Phosphorylation site(s) | |
|---|---|
| Position(s) on known amino acid sequence | Present in variant protein? |
| 1053 | No |
| 1169 | No |
| 1213 | No |
| 1242 | No |
| 1327 | No |
| 1333 | No |

The variant protein has the following domains, as determined by using InterPro. The domains are described in Table 33:

TABLE 33

| InterPro domain(s) | | |
|---|---|---|
| Domain description | Analysis type | Position(s) on protein |
| Vascular endothelial growth factor receptor, VEGFR | FPrintScan | 89-107, 125-136, 184-194, 242-254, 390-407, 448-462 |

TABLE 33-continued

| | InterPro domain(s) | |
|---|---|---|
| Domain description | Analysis type | Position(s) on protein |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313, 570-638, 675-734 |
| Immunoglobulin V-type | HMMSmart | 247-313, 572-638 |
| Immunoglobulin C2 type | HMMSmart | 149-214, 243-318, 348-412, 568-643, 673-725 |
| Immunoglobulin subtype | HMMSmart | 38-129, 143-224, 237-329, 344-425, 439-553, 562-658 |
| Immunoglobulin-like | ProfileScan | 32-107, 230-327, 349-404, 428-553, 556-654, 661-732 |

Variant protein HSFLT_P13 (SEQ ID NO:20) is encoded by the following transcript(s): HSFLT_T17 (SEQ ID NO:7), for which the coding portion starts at position 315 and ends at position 2522. The transcript also has the following SNPs as listed in Table 34 (given according to their position on the nucleotide sequence, with the alternative nucleic acid listed; the presence of known SNPs in variant protein HSFLT_P13 (SEQ ID NO:20) sequence provides support for the deduced sequence of this variant protein according to the present invention).

TABLE 34

| Nucleic acid SNPs | |
|---|---|
| Polymorphism | SNP position(s) on nucleotide sequence |
| -> C | 823 |
| T -> C | 1063, 1342 |
| A -> G | 1165, 1325, 1495 |
| C -> T | 1533 |
| G -> A | 2018 |

Variant protein HSFLT_P14 (SEQ ID NO:21) according to the present invention has an amino acid sequence as given at the end of the application; it is encoded by transcript(s) HSFLT_T19 (SEQ ID NO:8). An alignment is given to the known protein (Vascular endothelial growth factor receptor 1 precursor) in the alignment table on the attached CD-ROM. A brief description of the relationship of the variant protein according to the present invention to each such aligned protein is as follows:
1. Comparison report between HSFLT_P14 (SEQ ID NO:21) and VGR1_HUMAN (SEQ ID NO: 359):
A. An isolated chimeric polypeptide as set forth in HSFLT_P14 (SEQ ID NO:21), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE
RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV-QISTPRPVKLLRGHTLVLNCTATTPLNTRVQMTWSY-PDEKNKRASVRRRIDQSNSHANIFYSVLTIDKM QNKDKGLYTCRVRSGPSFKSVNTSVHIY-DKAFITVKHRKQQV-LETVAGKRSYRLSMKVKAFPSPEVVWLKDG LPATEKSARYLTRGYSLIIKDVTEEDAG-NYTILLSIKQSNVFKNLTATLIVNVKP-QIYEKAVSSFPDPALYPLGSR QILTCTAYGIPQPTIKW-FWHPCNHNHSEARCDFCSNNEESFILDADSNMGNR-IESITQRMAIIEGKNK corresponding to amino acids 1-517 of VGR1_HUMAN (SEQ ID NO: 359), which also corresponds to amino acids 1-517 of HSFLT_P14 (SEQ ID NO:21), and a second amino acid sequence being at least 70%, optionally at least 80%, preferably at least 85%, more preferably at least 90% and most preferably at least 95% homologous to a polypeptide having the sequence YLDIRTE-EQIFSFIQKTQTLKLTVSCKAAF (SEQ ID NO: 468) corresponding to amino acids 518-547 of HSFLT_P14 (SEQ ID NO:21), wherein said first amino acid sequence and second amino acid sequence are contiguous and in a sequential order.

B. An isolated polypeptide encoding for an edge portion of HSFLT_P14 (SEQ ID NO:21), comprising an amino acid sequence being at least 70%, optionally at least about 80%, preferably at least about 85%, more preferably at least about 90% and most preferably at least about 95% homologous to the sequence YLDIRTEEQIFSFIQKTQTLKLTVSCKAAF (SEQ ID NO: 468) of HSFLT_P14 (SEQ ID NO:21).

The location of the variant protein was determined according to results from a number of different software programs and analyses, including analyses from SignalP and other specialized programs. The variant protein is secreted.

Variant protein HSFLT_P14 (SEQ ID NO:21) also has the following non-silent SNPs (Single Nucleotide Polymorphisms) as listed in Table 35, (given according to their position(s) on the amino acid sequence, with the alternative amino acid(s) listed; the presence of known SNPs in variant protein HSFLT_P14 (SEQ ID NO:21) sequence provides support for the deduced sequence of this variant protein according to the present invention).

TABLE 35

| Amino acid mutations | |
|---|---|
| SNP position(s) on amino acid sequence | Alternative amino acid(s) |
| 250 | L -> P |
| 284 | Q -> R |
| 343 | V -> A |
| 394 | D -> G |

The glycosylation sites of variant protein HSFLT_P14 (SEQ ID NO:21), as compared to the known protein Vascular endothelial growth factor receptor 1 precursor, are described in Table 36 (given according to their position(s) on the amino acid sequence in the first column; the second column indicates whether the glycosylation site is present in the variant protein; and the last column indicates whether the position is different on the variant protein).

TABLE 36

Glycosylation site(s)

| Position(s) on known amino acid sequence | Present in variant protein? | Position(s) on variant protein |
|---|---|---|
| 100 | Yes | 100 |
| 164 | Yes | 164 |
| 196 | Yes | 196 |
| 251 | Yes | 251 |
| 323 | Yes | 323 |
| 402 | Yes | 402 |
| 417 | Yes | 417 |
| 474 | Yes | 474 |
| 547 | No | |
| 597 | No | |
| 620 | No | |
| 625 | No | |
| 666 | No | |

The phosphorylation sites of variant protein HSFLT_P14 (SEQ ID NO:21), as compared to the known protein, are described in Table 37 (given according to their position(s) on the amino acid sequence in the first column; the second column indicates whether the phosphorylation site is present in the variant protein; and the last column indicates whether the position is different on the variant protein).

TABLE 37

Phosphorylation site(s)

| Position(s) on known amino acid sequence | Present in variant protein? |
|---|---|
| 1053 | No |
| 1169 | No |
| 1213 | No |
| 1242 | No |
| 1327 | No |
| 1333 | No |

The variant protein has the following domains, as determined by using InterPro. The domains are described in Table 38:

TABLE 38

InterPro domain(s)

| Domain description | Analysis type | Position(s) on protein |
|---|---|---|
| Vascular endothelial growth factor receptor, VEGFR | FPrintScan | 89-107, 125-136, 184-194, 242-254, 390-407, 448-462 |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313 |
| Immunoglobulin C2 type | HMMSmart | 149-214, 243-318, 348-412 |
| Immunoglobulin subtype | HMMSmart | 38-129, 143-224, 237-329, 344-425 |
| Immunoglobulin-like | ProfileScan | 32-107, 230-327, 349-404, 428-467 |

Variant protein HSFLT_P14 (SEQ ID NO:21) is encoded by the following transcript(s): HSFLT_T19 (SEQ ID NO:8), for which the coding portion starts at position 315 and ends at position 1955. The transcript also has the following SNPs as listed in Table 39 (given according to their position on the nucleotide sequence, with the alternative nucleic acid listed; the presence of known SNPs in variant protein HSFLT_P14 (SEQ ID NO:21) sequence provides support for the deduced sequence of this variant protein according to the present invention).

TABLE 39

Nucleic acid SNPs

| Polymorphism | SNP position(s) on nucleotide sequence |
|---|---|
| -> C | 823 |
| T -> C | 1063, 1342, |
| A -> G | 1165, 1325, 1495, 2465 |
| C -> T | 1533 |

Variant protein HSFLT_P15 (SEQ ID NO:22) according to the present invention has an amino acid sequence as given at the end of the application; it is encoded by transcript(s) HSFLT_T20 (SEQ ID NO:9). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P15 (SEQ ID NO:22) and VGR1_HUMAN (SEQ ID NO: 359):

A. An isolated chimeric polypeptide as set forth in HSFLT_P15 (SEQ ID NO:22), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV-QISTPRPVKLLRGHTLVLNCTATTPLNTRVQMTWSY-PDEKNKRASVRRRIDQSNSHANIFYSVLTIDKM QNKDKGLYTCRVRSGPSFKSVNTSVHIY corresponding to amino acids 1-329 of VGR1_HUMAN (SEQ ID NO: 359), which also corresponds to amino acids 1-329 of HSFLT_P15 (SEQ ID NO:22), and a second amino acid sequence being at least 70%, optionally at least 80%, preferably at least 85%, more preferably at least 90% and most preferably at least 95% homologous to a polypeptide having the sequence GKHSSALPTHAMLSNHCRCLCSLNKS-VFCWPRVTLS (SEQ ID NO: 469) corresponding to amino acids 330-365 of HSFLT_P15 (SEQ ID NO:22), wherein said first amino acid sequence and second amino acid sequence are contiguous and in a sequential order.

B. An isolated polypeptide encoding for an edge portion of HSFLT_P15 (SEQ ID NO:22), comprising an amino acid sequence being at least 70%, optionally at least about 80%, preferably at least about 85%, more preferably at least about 90% and most preferably at least about 95% homologous to the sequence GKHSSALPTHAMLSNHCRCLCSLNKS-VFCWPRVTLS (SEQ ID NO: 469) of HSFLT_P15 (SEQ ID NO:22).

The location of the variant protein was determined according to results from a number of different software programs and analyses, including analyses from SignalP and other specialized programs. The variant protein is secreted.

Variant protein HSFLT_P15 (SEQ ID NO:22) also has the following non-silent SNPs (Single Nucleotide Polymorphisms) as listed in Table 40, (given according to their position(s) on the amino acid sequence, with the alternative amino acid(s) listed; the presence of known SNPs in variant protein HSFLT_P15 (SEQ ID NO:22) sequence provides support for the deduced sequence of this variant protein according to the present invention).

TABLE 40

Amino acid mutations

| SNP position(s) on amino acid sequence | Alternative amino acid(s) |
|---|---|
| 250 | L -> P |
| 284 | Q -> R |

The glycosylation sites of variant protein HSFLT_P15 (SEQ ID NO:22), as compared to the known protein Vascular endothelial growth factor receptor 1 precursor, are described in Table 41 (given according to their position(s) on the amino acid sequence in the first column; the second column indicates whether the glycosylation site is present in the variant protein; and the last column indicates whether the position is different on the variant protein).

TABLE 41

Glycosylation site(s)

| Position(s) on known amino acid sequence | Present in variant protein? | Position(s) on variant protein |
|---|---|---|
| 100 | Yes | 100 |
| 164 | Yes | 164 |
| 196 | Yes | 196 |

TABLE 41-continued

Glycosylation site(s)

| Position(s) on known amino acid sequence | Present in variant protein? | Position(s) on variant protein |
|---|---|---|
| 251 | Yes | 251 |
| 323 | Yes | 323 |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P15 (SEQ ID NO:22), as compared to the known protein, are described in Table 42 (given according to their position(s) on the amino acid sequence in the first column; the second column indicates whether the phosphorylation site is present in the variant protein; and the last column indicates whether the position is different on the variant protein).

TABLE 42

Phosphorylation site(s)

| Position(s) on known amino acid sequence | Present in variant protein? |
|---|---|
| 1053 | No |
| 1169 | No |
| 1213 | No |
| 1242 | No |
| 1327 | No |
| 1333 | No |

The variant protein has the following domains, as determined by using InterPro. The domains are described in Table 43:

TABLE 43

InterPro domain(s)

| Domain description | Analysis type | Position(s) on protein |
|---|---|---|
| Vascular endothelial growth factor receptor, VEGFR | FPrintScan | 89-107, 125-136, 184-194, 242-254 |
| Vascular endothelial growth factor receptor 1, VEGFR1 | FPrintScan | 26-41, 79-93, 130-155, 224-247, 273-290 |
| Immunoglobulin C2 type | HMMSmart | 149-214, 243-318 |
| Immunoglobulin subtype | HMMSmart | 38-129, 143-224, 237-329 |
| Immunoglobulin-like | ProfileScan | 32-107, 230-327 |

Variant protein HSFLT_P15 (SEQ ID NO:22) is encoded by the following transcript(s): HSFLT_T20 (SEQ ID NO:9), for which the coding portion starts at position 315 and ends at position 1409. The transcript also has the following SNPs as listed in Table 44 (given according to their position on the nucleotide sequence, with the alternative nucleic acid listed; the presence of known SNPs in variant protein HSFLT_P15 (SEQ ID NO:22) sequence provides support for the deduced sequence of this variant protein according to the present invention).

TABLE 44

Nucleic acid SNPs

| Polymorphism | SNP position(s) on nucleotide sequence |
|---|---|
| -> C | 823 |
| T -> C | 1063 |
| A -> G | 1165 |

Variant protein HSFLT_P16 (SEQ ID NO:23) according to the present invention has an amino acid sequence as given at the end of the application; it is encoded by transcript(s) HSFLT_T21 (SEQ ID NO:10). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P16 (SEQ ID NO:23) and VGR1_HUMAN (SEQ ID NO: 359):

A. An isolated chimeric polypeptide as set forth in HSFLT_P16 (SEQ ID NO:23), comprising an amino acid sequence being at least 90% homologous to MVIVEYCK-YGNLSNYLKSKRDLFFLNKDAALHMEP-KKEKMEPGLEQGKKPRLDSVTSSES-FASSGFQEDKSLS DVEEEEDSDGFYKEPITMEDLISYSFQ-VARGMEFLSSRKCIHRDLAARNILLSEN-NVVKICDFGLARDIYKNPDY VRKGDTRLPLKW-MAPESIFDKIYSTKSDVWSYGVLLWEIFSLGGSPYP-GVQMDEDFCSRLREGMRMRAPEYST PEIYQIMLD-CWHRDPKERPRFAELVEKLGDLLQAN-VQQDGKDYIPINAILTGNSGFTYSTPAF-SEDFFKESISAPK FNSGSSDDVRYVNAFKFMSLERIKT-FEELLPNATSMFDDYQGDSSTLLASPM-LKRFTWTDSKPKASLKIDLRVT SKSKESGLSDVS-RPSFCHSSCGHVSEGKRRFTYDHAELERKIACCSPPP-DYNSVVLYSTPPI corresponding to amino acids 906-1338 of VGR1_HUMAN (SEQ ID NO: 359), which also corresponds to amino acids 1-433 of HSFLT_P16 (SEQ ID NO:23).

The location of the variant protein was determined according to results from a number of different software programs and analyses, including analyses from SignalP and other specialized programs. The variant protein is intracellular.

The glycosylation sites of variant protein HSFLT_P16 (SEQ ID NO:23), as compared to the known protein Vascular endothelial growth factor receptor 1 precursor, are described in Table 45 (given according to their position(s) on the amino acid sequence in the first column; the second column indicates whether the glycosylation site is present in the variant protein; and the last column indicates whether the position is different on the variant protein).

TABLE 45

Glycosylation site(s)

| Position(s) on known amino acid sequence | Present in variant protein? | Position(s) on variant protein |
|---|---|---|
| 100 | No | |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P16 (SEQ ID NO:23), as compared to the known protein, are described in Table 46 (given according to their position(s) on the amino acid sequence in the first column; the second column indicates whether the phosphorylation site is present in the variant protein; and the last column indicates whether the position is different on the variant protein).

TABLE 46

Phosphorylation site(s)

| Position(s) on known amino acid sequence | Present in variant protein? | Position(s) on variant protein |
|---|---|---|
| 148 | Yes | 148 |
| 264 | Yes | 264 |
| 308 | Yes | 308 |
| 337 | Yes | 337 |
| 422 | Yes | 422 |
| 428 | Yes | 428 |

The variant protein has the following domains, as determined by using InterPro. The domains are described in Table 47:

TABLE 47

InterPro domain(s)

| Domain description | Analysis type | Position(s) on protein |
|---|---|---|
| Protein kinase | BlastProDom | 1-22, 88-254 |
| Protein kinase | HMMPfam | 27-249 |
| Tyrosine protein kinase | HMMSmart | 1-249 |
| Serine | HMMSmart | 1-253 |
| Protein kinase | ProfileScan | 1-253 |
| Tyrosine protein kinase, active site | ScanRegExp | 113-125 |

Variant protein HSFLT_P16 (SEQ ID NO:23) is encoded by the following transcript(s): HSFLT_T21 (SEQ ID NO:10), for which the coding portion starts at position 142 and ends at position 1440. The transcript also has the following SNPs as listed in Table 48 (given according to their position on the nucleotide sequence, with the alternative nucleic acid listed; the presence of known SNPs in variant protein HSFLT_P16 (SEQ ID NO:23) sequence provides support for the deduced sequence of this variant protein according to the present invention).

TABLE 48

Nucleic acid SNPs

| Polymorphism | SNP position(s) on nucleotide sequence |
|---|---|
| C -> A | 177 |
| A -> G | 498, 2533, 4052 |
| T -> C | 630, 1065 |
| T -> | 1589 |

TABLE 48-continued

Nucleic acid SNPs

| Polymorphism | SNP position(s) on nucleotide sequence |
|---|---|
| C -> T | 1790 |
| G -> T | 2711 |
| T -> G | 2958, 2963, 4081 |
| A -> C | 3799 |

Variant protein HSFLT_P17 (SEQ ID NO:24) according to the present invention has an amino acid sequence as given at the end of the application; it is encoded by transcript(s) HSFLT_T22 (SEQ ID NO:11). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P17 (SEQ ID NO:24) and VGR1_HUMAN (SEQ ID NO: 359):

A. An isolated chimeric polypeptide as set forth in HSFLT_P17 (SEQ ID NO:24), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKK corresponding to amino acids 1-171 of VGR1_HUMAN (SEQ ID NO: 359), which also corresponds to amino acids 1-171 of HSFLT_P17 (SEQ ID NO:24), and a second amino acid sequence being at least 70%, optionally at least 80%, preferably at least 85%, more preferably at least 90% and most preferably at least 95% homologous to a polypeptide having the sequence VNLN-TAILSILSLQISIMKFYSFYLSGIISLQTPGLLSGLSCN (SEQ ID NO: 470) corresponding to amino acids 172-214 of HSFLT_P17 (SEQ ID NO:24), wherein said first amino acid sequence and second amino acid sequence are contiguous and in a sequential order.

B. An isolated polypeptide encoding for an edge portion of HSFLT_P17 (SEQ ID NO:24), comprising an amino acid sequence being at least 70%, optionally at least about 80%, preferably at least about 85%, more preferably at least about 90% and most preferably at least about 95% homologous to the sequence VNLNTAILSILSLQISIMKFYSFYLSGI-ISLQTPGLLSGLSCN (SEQ ID NO: 470) of HSFLT_P17 (SEQ ID NO:24).

The location of the variant protein was determined according to results from a number of different software programs and analyses, including analyses from SignalP and other specialized programs. The variant protein is secreted.

The glycosylation sites of variant protein HSFLT_P17 (SEQ ID NO:24), as compared to the known protein Vascular endothelial growth factor receptor 1 precursor, are described in Table 49 (given according to their position(s) on the amino acid sequence in the first column; the second column indicates whether the glycosylation site is present in the variant protein; and the last column indicates whether the position is different on the variant protein).

TABLE 49

Glycosylation site(s)

| Position(s) on known amino acid sequence | Present in variant protein? | Position(s) on variant protein |
|---|---|---|
| 100 | Yes | 100 |
| 164 | Yes | 164 |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P17 (SEQ ID NO:24), as compared to the known protein, are described in Table 50 (given according to their position(s) on the amino acid sequence in the first column; the second column indicates whether the phosphorylation site is present in the variant protein; and the last column indicates whether the position is different on the variant protein).

TABLE 50

Phosphorylation site(s)

| Position(s) on known amino acid sequence | Present in variant protein? | Position(s) on variant protein |
|---|---|---|
| 1053 | No | |
| 1169 | No | |
| 1213 | No | |
| 1242 | No | |
| 1327 | No | |
| 1333 | No | |

The variant protein has the following domains, as determined by using InterPro. The domains are described in Table 51:

TABLE 51

InterPro domain(s)

| Domain description | Analysis type | Position(s) on protein |
|---|---|---|
| Vascular endothelial growth factor receptor, VEGFR | FPrintScan | 89-107, 125-136 |
| Vascular endothelial growth factor receptor 1, VEGFR1 | FPrintScan | 26-41, 79-93, 130-155 |
| Immunoglobulin-like | ProfileScan | 32-107 |

Variant protein HSFLT_P17 (SEQ ID NO:24) is encoded by the following transcript(s): HSFLT_T22 (SEQ ID NO:11), for which the coding portion starts at position 315 and ends at position 956. The transcript also has the following SNPs as listed in Table 52 (given according to their position on the nucleotide sequence, with the alternative nucleic acid listed; the presence of known SNPs in variant protein HSFLT_P17 (SEQ ID NO:24) sequence provides support for the deduced sequence of this variant protein according to the present invention).

TABLE 52

Nucleic acid SNPs

| Polymorphism | SNP position(s) on nucleotide sequence |
|---|---|
| -> C | 823 |

Variant protein HSFLT_P18 (SEQ ID NO:25) according to the present invention has an amino acid sequence as given at the end of the application; it is encoded by transcript(s) HSFLT_T23 (SEQ ID NO:12). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P18 (SEQ ID NO:25) and VGR1_HUMAN (SEQ ID NO: 359):

A. An isolated chimeric polypeptide as set forth in HSFLT_P18 (SEQ ID NO:25), comprising an amino acid sequence being at least 90% homologous to MEDLISYSFQ-VARGMEFLSSRKCIHRDLAARNILLSEN-NVVKICDFGLARDIYKNPDYVRKGDTRL-PLKWMAPE SIFDKIYSTKSDVWSYGVLLWEIFS-LGGSPYPGVQMDEDFCSRLREGMRMRAP-EYSTPEIYQIMLDCWHRDPKE RPRFAELVEK-LGDLLQANVQQDGKDYIPINAILTGNSGFTYSTPAFS-EDFFKESISAPKFNSGSSDDVRYVNAFK FMSLERIKT-FEELLPNATSMFDDYQGDSSTLLASPM-LKRFTWTDSKPKASLKIDLRVTSKSKES-GLSDVSRPSFC HSSCGHVSEGKRRFTYDHAELERKI-ACCSPPPDYNSVVLYSTPPI corresponding to amino acids 996-1338 of VGR1_HUMAN (SEQ ID NO: 359), which also corresponds to amino acids 1-343 of HSFLT_P18 (SEQ ID NO:25).

The location of the variant protein was determined according to results from a number of different software programs and analyses, including analyses from SignalP and other specialized programs. The variant protein is intracellular.

The glycosylation sites of variant protein HSFLT_P18 (SEQ ID NO:25), as compared to the known protein Vascular endothelial growth factor receptor 1 precursor, are described in Table 53 (given according to their position(s) on the amino acid sequence in the first column; the second column indicates whether the glycosylation site is present in the variant protein; and the last column indicates whether the position is different on the variant protein).

TABLE 53

Glycosylation site(s)

| Position(s) on known amino acid sequence | Present in variant protein? | Position(s) on variant protein |
|---|---|---|
| 100 | No | |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P18 (SEQ ID NO:25), as compared to the known protein, are described in Table 54 (given according to their position(s) on the amino acid sequence in the first column; the second column indicates whether the phosphorylation site is present in the variant protein; and the last column indicates whether the position is different on the variant protein).

TABLE 54

Phosphorylation site(s)

| Position(s) on known amino acid sequence | Present in variant protein? | Position(s) on variant protein |
|---|---|---|
| 58 | Yes | 58 |
| 174 | Yes | 174 |
| 218 | Yes | 218 |
| 247 | Yes | 247 |
| 332 | Yes | 332 |
| 338 | Yes | 338 |

The variant protein has the following domains, as determined by using InterPro. The domains are described in Table 55:

TABLE 55

InterPro domain(s)

| Domain description | Analysis type | Position(s) on protein |
|---|---|---|
| Protein kinase | BlastProDom | 1-164 |
| Tyrosine protein kinase | FPrintScan | 17-35, 66-76, 85-107, 130-152 |
| Protein kinase | HMMPfam | 1-159 |
| Tyrosine protein kinase | HMMSmart | 1-159 |
| Serine | HMMSmart | 1-163 |
| Protein kinase | ProfileScan | 1-163 |
| Tyrosine protein kinase, active site | ScanRegExp | 23-35 |

Variant protein HSFLT_P18 (SEQ ID NO:25) is encoded by the following transcript(s): HSFLT_T23 (SEQ ID NO:12), for which the coding portion starts at position 66 and ends at position 1094. The transcript also has the following SNPs as listed in Table 56 (given according to their position on the nucleotide sequence, with the alternative nucleic acid listed; the presence of known SNPs in variant protein HSFLT_P18 (SEQ ID NO:25) sequence provides support for the deduced sequence of this variant protein according to the present invention).

TABLE 56

Nucleic acid SNPs

| Polymorphism | SNP position(s) on nucleotide sequence |
|---|---|
| A -> G | 152, 2187, 3706 |
| T -> C | 284, 719 |
| T -> | 1243 |
| C -> T | 1444 |
| G -> T | 2365 |
| T -> G | 2612, 2617, 3735 |
| A -> C | 3453 |

Variant protein HSFLT_P19 (SEQ ID NO:26) according to the present invention has an amino acid sequence as given at the end of the application; it is encoded by transcript(s) HSFLT_T24 (SEQ ID NO:13). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P19 (SEQ ID NO:26) and VGR1_HUMAN (SEQ ID NO: 359):

A. An isolated chimeric polypeptide as set forth in HSFLT_P19 (SEQ ID NO:26), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETESAIYIFIS corresponding to amino acids 1-129 of VGR1_HUMAN (SEQ ID NO: 359), which also corresponds to amino acids 1-129 of HSFLT_P19 (SEQ ID NO:26), and a second amino acid sequence being at least 70%, optionally at least 80%, preferably at least 85%, more preferably at least 90% and most preferably at least 95% homologous to a polypeptide having the sequence GKTSIFYILFAFALQMSHKSTLIH-WKGCFPSEYERNGLGKRFHPSCRHFRGCQF (SEQ ID NO: 471) corresponding to amino acids 130-183 of HSFLT_P19 (SEQ ID NO:26), wherein said first amino acid sequence and second amino acid sequence are contiguous and in a sequential order.

B. An isolated polypeptide encoding for an edge portion of HSFLT_P19 (SEQ ID NO:26), comprising an amino acid sequence being at least 70%, optionally at least about 80%, preferably at least about 85%, more preferably at least about 90% and most preferably at least about 95% homologous to the sequence GKTSIFYILFAFALQMSHKSTLIH-WKGCFPSEYERNGLGKRFHPSCRHFRGCQF (SEQ ID NO: 471) of HSFLT_P19 (SEQ ID NO:26).

The location of the variant protein was determined according to results from a number of different software programs and analyses, including analyses from SignalP and other specialized programs. The variant protein is membrane.

The glycosylation sites of variant protein HSFLT_P19 (SEQ ID NO:26), as compared to the known protein Vascular endothelial growth factor receptor 1 precursor, are described in Table 57 (given according to their position(s) on the amino acid sequence in the first column; the second column indicates whether the glycosylation site is present in the variant protein; and the last column indicates whether the position is different on the variant protein).

TABLE 57

Glycosylation site(s)

| Position(s) on known amino acid sequence | Present in variant protein? | Position(s) on variant protein |
|---|---|---|
| 100 | Yes | 100 |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P19 (SEQ ID NO:26), as compared to the known protein, are described in Table 58 (given according to their position(s) on the amino acid sequence in the first column; the second column indicates whether the phosphorylation site is present in the variant protein; and the last column indicates whether the position is different on the variant protein).

TABLE 58

Phosphorylation site(s)

| Position(s) on known amino acid sequence | Present in variant protein? | Position(s) on variant protein |
|---|---|---|
| 1053 | No | |
| 1169 | No | |
| 1213 | No | |
| 1242 | No | |
| 1327 | No | |
| 1333 | No | |

The variant protein has the following domains, as determined by using InterPro. The domains are described in Table 59:

TABLE 59

InterPro domain(s)

| Domain description | Analysis type | Position(s) on protein |
|---|---|---|
| Vascular endothelial growth factor receptor, VEGFR | FPrintScan | 89-107, 125-136 |
| Vascular endothelial growth factor receptor 1, VEGFR1 | FPrintScan | 26-41, 79-93 |
| Immunoglobulin-like | ProfileScan | 32-107 |

Variant protein HSFLT_P19 (SEQ ID NO:26) is encoded by the following transcript(s): HSFLT_T24 (SEQ ID NO:13), for which the coding portion starts at position 315 and ends at position 863.

Variant protein HSFLT_P20 (SEQ ID NO:27) according to the present invention has an amino acid sequence as given at the end of the application; it is encoded by transcript(s) HSFLT_T25 (SEQ ID NO:14). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P20 (SEQ ID NO:27) and VGR1_HUMAN (SEQ ID NO: 359):

A. An isolated chimeric polypeptide as set forth in HSFLT_P20 (SEQ ID NO:27), comprising an amino acid sequence being at least 90% homologous to MLDCWHRD-PKERPRFAELVEKLGDLLQAN-VQQDGKDYIPINAILTGNSGFTYSTPAF-SEDFFKESISAPKFNSGS SDDVRYVNAFKFMSLERIKTFEELLP-NATSMFDDYQGDSSTLLASPM-LKRFTWTDSKPKASLKIDLRVTSKSKE SGLSDVS-RPSFCHSSCGHVSEGKRRFTYDHAELERKIACCSPPP-DYNSVVLYSTPPI corresponding to amino acids 1133-1338 of VGR1_HUMAN (SEQ ID NO: 359), which also corresponds to amino acids 1-206 of HSFLT_P20 (SEQ ID NO:27).

The location of the variant protein was determined according to results from a number of different software programs and analyses, including analyses from SignalP and other specialized programs. The variant protein is intracellular.

The glycosylation sites of variant protein HSFLT_P20 (SEQ ID NO:27), as compared to the known protein Vascular endothelial growth factor receptor 1 precursor, are described in Table 60 (given according to their position(s) on the amino acid sequence in the first column; the second column indicates whether the glycosylation site is present in the variant protein; and the last column indicates whether the position is different on the variant protein).

TABLE 60

Glycosylation site(s)

| Position(s) on known amino acid sequence | Present in variant protein? | Position(s) on variant protein |
|---|---|---|
| 100 | No | |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P20 (SEQ ID NO:27), as compared to the known protein, are described in Table 61 (given according to their position(s) on the amino acid sequence in the first column; the second column indicates whether the phosphorylation site is present in the variant protein; and the last column indicates whether the position is different on the variant protein).

TABLE 61

Phosphorylation site(s)

| Position(s) on known amino acid sequence | Present in variant protein? | Position(s) on variant protein |
|---|---|---|
| 37 | Yes | 37 |
| 81 | Yes | 81 |
| 110 | Yes | 110 |
| 195 | Yes | 195 |
| 201 | Yes | 201 |
| 1053 | No | |

The variant protein has the following domains, as determined by using InterPro. The domains are described in Table 62:

TABLE 62

InterPro domain(s)

| Domain description | Analysis type | Position(s) on protein |
|---|---|---|
| Protein kinase | BlastProDom | 1-27 |

Variant protein HSFLT_P20 (SEQ ID NO:27) is encoded by the following transcript(s): HSFLT_T25 (SEQ ID NO:14), for which coding portion starts at position 693 and ends at position 1310. The transcript also has the following SNPs as listed in Table 63 (given according to their position on the nucleotide sequence, with the alternative nucleic acid listed; the presence of known SNPs in variant protein HSFLT_P20 (SEQ ID NO:27) sequence provides support for the deduced sequence of this variant protein according to the present invention).

TABLE 63

Nucleic acid SNPs

| Polymorphism | SNP position on nucleotide sequence |
|---|---|
| T -> C | 935 |
| T -> | 1459 |
| C -> T | 1660 |
| A -> G | 2403, 3922 |
| G -> T | 2581 |
| T -> G | 2828, 2833, 3951 |
| A -> C | 3669 |

Variant protein HSFLT_P21 (SEQ ID NO:28) according to the present invention has an amino acid sequence as given at the end of the application; it is encoded by transcript(s) HSFLT_T26 (SEQ ID NO:15). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P21 (SEQ ID NO:28) and VGR1_HUMAN (SEQ ID NO: 359):

A. An isolated chimeric polypeptide as set forth in HSFLT_P21 (SEQ ID NO:28), comprising an amino acid sequence being at least 90% homologous to MSLERIKT-FEELLPNATSMFDDYQGDSSTLLASPM-LKRFTWTDSKPKASLKIDLRVTSKSKES-GLSDVSRPSFCH SSCGHVSEGKRRFTYDHAELERKI-ACCSPPPDYNSVVLYSTPPI corresponding to amino acids 1220-1338 of VGR1_HUMAN (SEQ ID NO: 359), which also corresponds to amino acids 1-119 of HSFLT_P21 (SEQ ID NO:28).

The location of the variant protein was determined according to results from a number of different software programs and analyses, including analyses from SignalP and other specialized programs. The variant protein is intracellular.

The glycosylation sites of variant protein HSFLT_P21 (SEQ ID NO:28), as compared to the known protein Vascular endothelial growth factor receptor 1 precursor, are described in Table 64 (given according to their position(s) on the amino acid sequence in the first column; the second column indicates whether the glycosylation site is present in the variant protein; and the last column indicates whether the position is different on the variant protein).

TABLE 64

Glycosylation site(s)

| Position(s) on known amino acid sequence | Present in variant protein? | Position(s) on variant protein |
|---|---|---|
| 100 | No | |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P21 (SEQ ID NO:28), as compared to the known protein, are described in Table 65 (given according to their position(s) on the amino acid sequence in the first column; the second column indicates whether the phosphorylation site is present in the variant protein; and the last column indicates whether the position is different on the variant protein).

TABLE 65

Phosphorylation site(s)

| Position(s) on known amino acid sequence | Present in variant protein? | Position(s) on variant protein |
|---|---|---|
| 23 | Yes | 23 |
| 108 | Yes | 108 |
| 114 | Yes | 114 |
| 1053 | No | |
| 1169 | No | |
| 1213 | No | |

Variant protein HSFLT_P21 (SEQ ID NO:28) is encoded by the following transcript(s): HSFLT_T26 (SEQ ID NO:15), for which the coding portion starts at position 265 and ends at position 621. The transcript also has the following SNPs as listed in Table 66 (given according to their position on the nucleotide sequence, with the alternative nucleic acid listed; the presence of known SNPs in variant protein HSFLT_P21 (SEQ ID NO:28) sequence provides support for the deduced sequence of this variant protein according to the present invention).

TABLE 66

Nucleic acid SNPs

| Polymorphism | SNP position on nucleotide sequence |
|---|---|
| G -> A | 36 |
| T -> C | 209, 246 |
| T -> | 770 |
| C -> T | 971 |
| A -> G | 1714, 3233 |
| G -> T | 1892 |
| T -> G | 2139, 2144, 3262 |
| A -> C | 2980 |

Variant protein HSFLT_P41 (SEQ ID NO:29) according to the present invention has an amino acid sequence as given at the end of the application; it is encoded by transcript(s) HSFLT_T21 (SEQ ID NO:10). An alignment is given to the known protein (Vascular endothelial growth factor receptor 1 precursor) in the alignment table on the attached CD-ROM. A brief description of the relationship of the variant protein according to the present invention to each such aligned protein is as follows:
1. Comparison report between HSFLT_P41 (SEQ ID NO:29) and VGR1_HUMAN (SEQ ID NO: 359):
A. An isolated chimeric polypeptide as set forth in HSFLT_P41 (SEQ ID NO:29), comprising a first amino acid sequence being at least 70%, optionally at least 80%, preferably at least 85%, more preferably at least 90% and most preferably at least 95%, homologous to a polypeptide having the sequence LWAACPAQACSGNAGQERGGLQSAA-GLPSQPSCFLQTGVGLANQ (SEQ ID NO: 577) corresponding to amino acids 1-44 of HSFLT_P41 (SEQ ID NO:29), and a second amino acid sequence being at least 90% homologous to GPLMVIVEYCKYGNLSNYLKSKRDLF-FLNKDAALHMEPKKEKMEP-GLEQGKKPRLDSVTSSESFASSGFQEDK SLSD-VEEEEDSDGFYKEPITMEDLISYSFQVARGMEFLSSR-KCIHRDLAARNILLSENNVVKICDFGLARDIYKNP DYVRKGDTRLPLKWMAPESIFD-KIYSTKSDVWSYGVLLWEIFS-LGGSPYPGVQMDEDFCSRLREGMRMRAPE YST-PEIYQIMLDCWHRDPKERPRFAELVEKLGDLLQANV-QQDGKDYIPINAILTGNSGFTYSTPAFSEDFFKESIS APKFNSGSSDDVRYVNAFKFMSLERIKT-FEELLPNATSMFDDYQGDSSTLLASPM-LKRFTWTDSKPKASLKIDL RVTSKSKESGLSDVS-RPSFCHSSCGHVSEGKRRFTYDHAELERKIACCSPPP-DYNSVVLYSTPPI corresponding to amino acids 903-1338 of VGR1_HUMAN (SEQ ID NO: 359), which also corresponds to amino acids 45-480 of HSFLT_P41 (SEQ ID NO:29), wherein said first amino acid sequence and second amino acid sequence are contiguous and in a sequential order.

B. An isolated polypeptide encoding for a head of HSFLT_P41 (SEQ ID NO:29), comprising a polypeptide being at least 70%, optionally at least about 80%, preferably at least about 85%, more preferably at least about 90% and most preferably at least about 95% homologous to the sequence LWAACPAQACSGNAGQERGGLQSAA-GLPSQPSCFLQTGVGLANQ (SEQ ID NO: 577) of HSFLT_P41 (SEQ ID NO:29).

The location of the variant protein was determined according to results from a number of different software programs and analyses, including analyses from SignalP and other specialized programs. The variant protein is intracellular.

The glycosylation sites of variant protein HSFLT_P41 (SEQ ID NO:29), as compared to the known protein Vascular endothelial growth factor receptor 1 precursor, are described in Table 67 (given according to their position(s) on the amino acid sequence in the first column; the second column indicates whether the glycosylation site is present in the variant protein; and the last column indicates whether the position is different on the variant protein).

TABLE 67

Glycosylation site(s)

| Position(s) on known amino acid sequence | Present in variant protein? | Position(s) on variant protein |
|---|---|---|
| 100 | No | |
| 164 | No | |
| 196 | No | |
| 251 | No | |
| 323 | No | |
| 402 | No | |
| 417 | No | |
| 474 | No | |
| 547 | No | |
| 597 | No | |
| 620 | No | |
| 625 | No | |
| 666 | No | |

The phosphorylation sites of variant protein HSFLT_P41 (SEQ ID NO:29), as compared to the known protein, are described in Table 68 (given according to their position(s) on the amino acid sequence in the first column; the second column indicates whether the phosphorylation site is present in the variant protein; and the last column indicates whether the position is different on the variant protein).

TABLE 68

| | Phosphorylation site(s) | |
|---|---|---|
| Position(s) on known amino acid sequence | Present in variant protein? | Position(s) on variant protein |
| 195 | Yes | 195 |
| 311 | Yes | 311 |
| 355 | Yes | 355 |
| 384 | Yes | 384 |
| 469 | Yes | 469 |
| 475 | Yes | 475 |

The variant protein has the following domains, as determined by using InterPro. The domains are described in Table 69:

TABLE 69

| | InterPro domain(s) | |
|---|---|---|
| Domain description | Analysis type | Position(s) on protein |
| Protein kinase | BlastProDom | 45-69, 135-301 |
| Protein kinase | HMMPfam | 74-296 |
| Tyrosine protein kinase | HMMSmart | 9-296 |
| Serine | HMMSmart | 48-300 |
| Protein kinase | ProfileScan | 1-300 |
| Tyrosine protein kinase, active site | ScanRegExp | 160-172 |

Variant protein HSFLT_P41 (SEQ ID NO:29) is encoded by the following transcript(s): HSFLT_T21 (SEQ ID NO:10), coding portion starts at position 1 and ends at position 1440. The transcript also has the following SNPs as listed in Table 70 (given according to their position on the nucleotide sequence, with the alternative nucleic acid listed; the presence of known SNPs in variant protein HSFLT_P41 (SEQ ID NO:29) sequence provides support for the deduced sequence of this variant protein according to the present invention).

TABLE 70

| | Nucleic acid SNPs |
|---|---|
| Polymorphism | SNP position on nucleotide sequence |
| C -> A | 177 |
| A -> G | 498, 2533, 4052 |
| T -> C | 630, 1065 |
| T -> | 1589 |
| C -> T | 1790 |
| G -> T | 2711 |
| T -> G | 2958, 2963, 4081 |
| A -> C | 3799 |

Variant protein HSFLT_P48 (SEQ ID NO:30) according to the present invention has an amino acid sequence as given at the end of the application; it is encoded by transcript(s) HSFLT_T7 (SEQ ID NO:1). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P48 (SEQ ID NO:30) and VGR1_HUMAN (SEQ ID NO: 359):

A. An isolated chimeric polypeptide as set forth in HSFLT_P48 (SEQ ID NO:30), comprising a first amino acid sequence being at least 90% homologous to MVSYWDTGV-LLCALLSCLLLTGSSSGSKLKD-PELSLKGTQHIMQAGQTLHLQCRGEAAH-KWSLPEMVSKESE RLSITKSACGRNGKQFCSTLTLN-TAQANHTGFYSCKYLAVPTSKKKETE-SAIYIFISDTGRPFVEMYSEIPEIIHMT EGRELVIPCRVTSPNITVTLKKF-PLDTLIPDGKRIIWDSRKGFIIS-NATYKEIGLLTCEATVNGHLYKTNYLTHRQT NTIIDV-QISTPRPVKLLRGHTLVLNCTATTPLNTRVQMTWSY-PDEKNKRASVRRRIDQSNSHANIFYSVLTIDKM QNKDKGLYTCRVRSGPSFKSVNTSVHIY-DKAFITVKHRKQQV-LETVAGKRSYRLSMKVKAFPSPEVVWLKDG LPATEKSARYLTRGYSLIIKDVTEEDAG-NYTILLSIKQSNVFKNLTATLIVNVKP-QIYEKAVSSFPDPALYPLGSR QILTCTAYGIPQPTIKW-FWHPCNHNHSEARCDFCSNNEESFILDADSNMGNR-IESITQRMAIIEGKNK corresponding to amino acids 1-517 of VGR1_HUMAN (SEQ ID NO: 359), which also corresponds to amino acids 1-517 of HSFLT_P48 (SEQ ID NO:30), and a second amino acid sequence being at least 70%, optionally at least 80%, preferably at least 85%, more preferably at least 90% and most preferably at least 95% homologous to a polypeptide having the sequence LPPANS-SFMLPPTSFSSNYFHFLP (SEQ ID NO: 472) corresponding to amino acids 518-541 of HSFLT_P48 (SEQ ID NO:30), wherein said first amino acid sequence and second amino acid sequence are contiguous and in a sequential order.

B. An isolated polypeptide encoding for an edge portion of HSFLT_P48 (SEQ ID NO:30), comprising an amino acid sequence being at least 70%, optionally at least about 80%, preferably at least about 85%, more preferably at least about 90% and most preferably at least about 95% homologous to the sequence LPPANSSFMLPPTSFSSNYFHFLP (SEQ ID NO: 472) of HSFLT_P48 (SEQ ID NO:30).

The comparison between HSFLT_P48 (SEQ ID NO:30) and Q16333_HUMAN (SEQ ID NO: 552), given below, shows that the two sequences have no homology.

The location of the variant protein was determined according to results from a number of different software programs and analyses, including analyses from SignalP and other specialized programs. The variant protein is secreted.

Variant protein HSFLT_P48 (SEQ ID NO:30) also has the following non-silent SNPs (Single Nucleotide Polymorphisms) as listed in Table 71, (given according to their position(s) on the amino acid sequence, with the alternative amino acid(s) listed; the presence of known SNPs in variant protein HSFLT_P48 (SEQ ID NO:30) sequence provides support for the deduced sequence of this variant protein according to the present invention).

TABLE 71

| Amino acid mutations | |
|---|---|
| SNP position(s) on amino acid sequence | Alternative amino acid(s) |
| 250 | L -> P |
| 284 | Q -> R |
| 343 | V -> A |
| 394 | D -> G |

The glycosylation sites of variant protein HSFLT_P48 (SEQ ID NO:30), as compared to the known protein Vascular endothelial growth factor receptor 1 precursor, are described in Table 72 (given according to their position(s) on the amino acid sequence in the first column; the second column indicates whether the glycosylation site is present in the variant protein; and the last column indicates whether the position is different on the variant protein).

TABLE 72

Glycosylation site(s)

| Position(s) on known amino acid sequence | Present in variant protein? | Position(s) on variant protein |
|---|---|---|
| 100 | Yes | 100 |
| 164 | Yes | 164 |
| 196 | Yes | 196 |
| 251 | Yes | 251 |
| 323 | Yes | 323 |
| 402 | Yes | 402 |
| 417 | Yes | 417 |
| 474 | Yes | 474 |
| 547 | No | |
| 597 | No | |
| 620 | No | |
| 625 | No | |
| 666 | No | |

The phosphorylation sites of variant protein HSFLT_P48 (SEQ ID NO:30), as compared to the known protein, are described in Table 73 (given according to their position(s) on the amino acid sequence in the first column; the second column indicates whether the phosphorylation site is present in the variant protein; and the last column indicates whether the position is different on the variant protein).

TABLE 73

Phosphorylation site(s)

| Position(s) on known amino acid sequence | Present in variant protein? | Position(s) on variant protein |
|---|---|---|
| 1053 | No | |
| 1169 | No | |
| 1213 | No | |
| 1242 | No | |
| 1327 | No | |
| 1333 | No | |

The variant protein has the following domains, as determined by using InterPro. The domains are described in Table 74:

TABLE 74

InterPro domain(s)

| Domain description | Analysis type | Position(s) on protein |
|---|---|---|
| Vascular endothelial growth factor receptor, VEGFR | FPrintScan | 89-107, 125-136, 184-194, 242-254, 390-407, 448-462 |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313 |
| Immunoglobulin C2 type | HMMSmart | 149-214, 243-318, 348-412 |
| Immunoglobulin subtype | HMMSmart | 38-129, 143-224, 237-329, 344-425 |
| Immunoglobulin-like | ProfileScan | 32-107, 230-327, 349-404, 428-467 |

Variant protein HSFLT_P48 (SEQ ID NO:30) is encoded by the following transcript(s): HSFLT_T7 (SEQ ID NO:1), for which the coding portion starts at position 315 and ends at position 1937. The transcript also has the following SNPs as listed in Table 75 (given according to their position on the nucleotide sequence, with the alternative nucleic acid listed; the presence of known SNPs in variant protein HSFLT_P48 (SEQ ID NO:30) sequence provides support for the deduced sequence of this variant protein according to the present invention).

TABLE 75

Nucleic acid SNPs

| Polymorphism | SNP position on nucleotide sequence |
|---|---|
| -> C | 823 |
| T -> C | 1063, 1342, 2939, 3603, 4038 |
| A -> G | 1165, 1325, 1495, 2677, 3471, 5506, 7025 |
| C -> T | 1533, 4763 |
| G -> A | 2103 |
| C -> A | 3150 |
| T -> | 4562 |
| G -> T | 5684 |
| T -> G | 5931, 5936, 7054 |
| A -> C | 6772 |

Variant protein HSFLT_P49 (SEQ ID NO:31) according to the present invention has an amino acid sequence as given at the end of the application; it is encoded by transcript(s) HSFLT_T8 (SEQ ID NO:2). An alignment is given to the known protein (Vascular endothelial growth factor receptor 1 precursor) in the alignment table on the attached CD-ROM. A brief description of the relationship of the variant protein according to the present invention to each such aligned protein is as follows:

1. Comparison report between HSFLT_P49 (SEQ ID NO:31) and VGR1_HUMAN (SEQ ID NO: 359):

A. An isolated chimeric polypeptide as set forth in HSFLT_P49 (SEQ ID NO:31), comprising a first amino acid sequence being at least 90% homologous to MVSYWDTGV-LLCALLSCLLLTGSSSGSKLKD-
PELSLKGTQHIMQAGQTLHLQCRGEAAH-
KWSLPEMVSKESE
RLSITKSACGRNGKQFCSTLTLN-
TAQANHTGFYSCKYLAVPTSKKKETE-
SAIYIFISDTGRPFVEMYSEIPEIIHMT
EGRELVIPCRVTSPNITVTLKKF-
PLDTLIPDGKRIIWDSRKGFIIS-
NATYKEIGLLTCEATVNGHLYKTNYLTHRQT NTIIDV-
QISTPRPVKLLRGHTLVLNCTATTPLNTRVQMTWSY-
PDEKNKRASVRRRIDQSNSHANIFYSVLTIDKM
QNKDKGLYTCRVRSGPSFKSVNTSVHIY-
DKAFITVKHRKQQV-
LETVAGKRSYRLSMKVKAFPSPEVVWLKDG
LPATEKSARYLTRGYSLIIKDVTEEDAG-
NYTILLSIKQSNVFKNLTATLIVNVKP-
QIYEKAVSSFPDPALYPLGSR QILTCTAYGIPQPTIKW- FWHPCNHNHSEARCDFCSNNEESFILDADSNMGNR-IESITQRMAIIEGKNKMASTLVV ADSRISGIYI-CIASNKVGTVGRNISFYIT corresponding to amino acids 1-553 of VGR1_HUMAN (SEQ ID NO: 359), which also corresponds to amino acids 1-553 of HSFLT_P49 (SEQ ID NO:31), and a second amino acid sequence being at least 70%, optionally at least 80%, preferably at least 85%, more preferably at least 90% and most preferably at least 95% homologous to a polypeptide having the sequence ELSNFE-CLHPCSQE (SEQ ID NO: 473) corresponding to amino acids 554-567 of HSFLT_P49 (SEQ ID NO:31), wherein said first amino acid sequence and second amino acid sequence are contiguous and in a sequential order.

B. An isolated polypeptide encoding for an edge portion of HSFLT_P49 (SEQ ID NO:31), comprising an amino acid sequence being at least 70%, optionally at least about 80%, preferably at least about 85%, more preferably at least about 90% and most preferably at least about 95% homologous to the sequence ELSNFECLHPCSQE (SEQ ID NO: 473) of HSFLT_P49 (SEQ ID NO:31).

HSFLT_P49 (SEQ ID NO:31) and Q16332_HUMAN (SEQ ID NO: 553) do not show homology.

The location of the variant protein was determined according to results from a number of different software programs and analyses, including analyses from SignalP and other specialized programs. The variant protein is secreted.

Variant protein HSFLT_P49 (SEQ ID NO:31) also has the following non-silent SNPs (Single Nucleotide Polymorphisms) as listed in Table 76, (given according to their position(s) on the amino acid sequence, with the alternative amino acid(s) listed; the presence of known SNPs in variant protein HSFLT_P49 (SEQ ID NO:31) sequence provides support for the deduced sequence of this variant protein according to the present invention).

TABLE 76

Amino acid mutations

| SNP position(s) on amino acid sequence | Alternative amino acid(s) |
|---|---|
| 250 | L -> P |
| 284 | Q -> R |
| 343 | V -> A |
| 394 | D -> G |

The glycosylation sites of variant protein HSFLT_P49 (SEQ ID NO:31), as compared to the known protein Vascular endothelial growth factor receptor 1 precursor, are described in Table 77 (given according to their position(s) on the amino acid sequence in the first column; the second column indicates whether the glycosylation site is present in the variant protein; and the last column indicates whether the position is different on the variant protein).

TABLE 77

Glycosylation site(s)

| Position(s) on known amino acid sequence | Present in variant protein? | Position(s) on variant protein |
|---|---|---|
| 100 | Yes | 100 |
| 164 | Yes | 164 |
| 196 | Yes | 196 |
| 251 | Yes | 251 |
| 323 | Yes | 323 |
| 402 | Yes | 402 |
| 417 | Yes | 417 |

TABLE 77-continued

Glycosylation site(s)

| Position(s) on known amino acid sequence | Present in variant protein? | Position(s) on variant protein |
|---|---|---|
| 474 | Yes | 474 |
| 547 | Yes | 547 |
| 597 | No | |
| 620 | No | |
| 625 | No | |
| 666 | No | |

The phosphorylation sites of variant protein HSFLT_P49 (SEQ ID NO:31), as compared to the known protein, are described in Table 78 (given according to their position(s) on the amino acid sequence in the first column; the second column indicates whether the phosphorylation site is present in the variant protein; and the last column indicates whether the position is different on the variant protein).

TABLE 78

Phosphorylation site(s)

| Position(s) on known amino acid sequence | Present in variant protein? | Position(s) on variant protein |
|---|---|---|
| 1053 | No | |
| 1169 | No | |
| 1213 | No | |
| 1242 | No | |
| 1327 | No | |
| 1333 | No | |

The variant protein has the following domains, as determined by using InterPro. The domains are described in Table 79:

TABLE 79

InterPro domain(s)

| Domain description | Analysis type | Position(s) on protein |
|---|---|---|
| Vascular endothelial growth factor receptor, VEGFR | FPrintScan | 89-107, 125-136, 184-194, 242-254, 390-407, 448-462 |
| Vascular endothelial growth factor receptor 1, VEGFR1 | FPrintScan | 26-41, 79-93, 130-155, 224-247, 273-290, 350-370, 375-389 |
| Immunoglobulin-like | HMMPfam | 245-313 |
| Immunoglobulin C2 type | HMMSmart | 149-214, 243-318, 348-412 |
| Immunoglobulin subtype | HMMSmart | 38-129, 143-224, 237-329, 344-425, 439-553 |
| Immunoglobulin-like | ProfileScan | 32-107, 230-327, 349-404, 428-553 |

Variant protein HSFLT_P49 (SEQ ID NO:31) is encoded by the following transcript(s): HSFLT_T8 (SEQ ID NO:2), for which the coding portion starts at position 315 and ends at position 2015. The transcript also has the following SNPs as listed in Table 80 (given according to their position on the nucleotide sequence, with the alternative nucleic acid listed; the presence of known SNPs in variant protein HSFLT_P49 (SEQ ID NO:31) sequence provides support for the deduced sequence of this variant protein according to the present invention).

TABLE 80

Nucleic acid SNPs

| Polymorphism | SNP position(s) on nucleotide sequence |
|---|---|
| -> C | 823 |
| T -> C | 1063, 1342, 2919, 3583, 4018 |
| A -> G | 1165, 1325, 1495, 2657, 3451, 5486, 7005 |
| C -> T | 1533, 4743 |
| G -> A | 2083 |
| C -> A | 3130 |
| T -> | 4542 |
| G -> T | 5664 |
| T -> G | 5911, 5916, 7034 |
| A -> C | 6752 |

As noted above, cluster HSFLT features 58 segment(s), which were listed in Table 7 above and for which the sequence(s) are given. These segment(s) are portions of nucleic acid sequence(s) which are described herein separately because they are of particular interest. A description of segment 20 according to the present invention is now provided.

Segment cluster HSFLT_N20 (SEQ ID NO:42) according to the present invention is supported by 2 libraries. The number of libraries was determined as previously described. This segment can be found in the following transcript(s): HSFLT_T20 (SEQ ID NO:9). Table 81 below describes the starting and ending position of this segment on each transcript.

TABLE 81

Segment location on transcripts

| Transcript name | Segment starting position | Segment ending position |
|---|---|---|
| HSFLT_T20 (SEQ ID NO: 9) | 1303 | 1731 |

Figure 4:
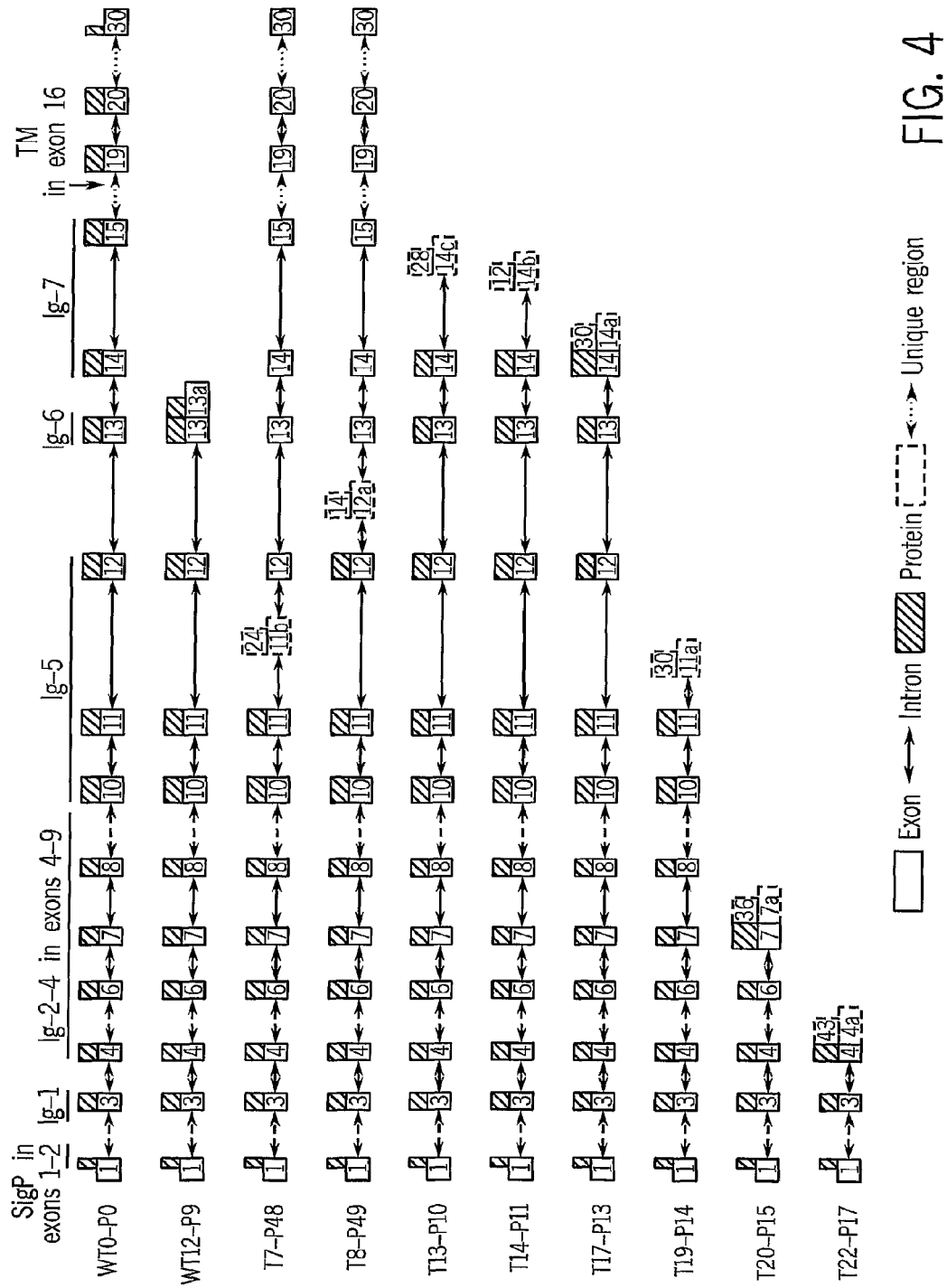
FIG. 4 shows the structure of the HSFLT variants mRNA and protein. Exons are represented by white boxes, while introns are represented by two headed arrows. Proteins are shown in boxes with upper right to lower left fill. The unique regions are represented by white boxes with dashed frame.

FIG. 4 shows the structure of the various HSFLT variants described above, for both mRNA and protein. "WT" refers to the known protein/mRNA. Exons are represented by white boxes, while introns are represented by two headed arrows. Proteins are shown in boxes with upper right to lower left fill. The unique regions are represented by white boxes with dashed frame.

Figure 5:
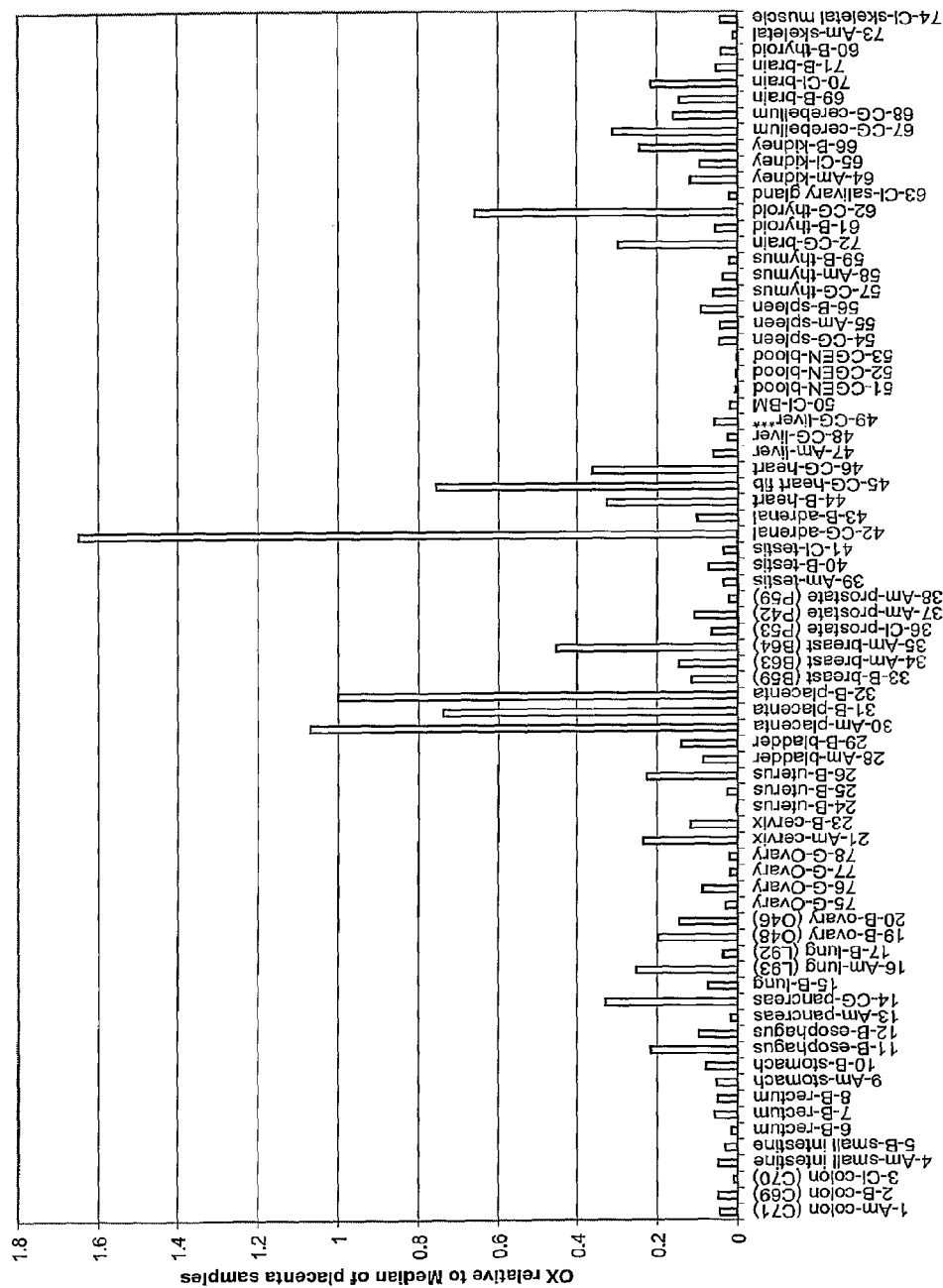
FIG. 5 shows expression of *Homo sapiens* fms-related tyrosine kinase 1 (vascular endothelial growth factor/vascular permeability factor receptor) (FLT1) transcripts detectable by or according to seg20—HSFLT_seg20 (SEQ ID NO:363) amplicon and primers HSFLT_seg20F (SEQ ID NO:361) and HSFLT_seg20R (SEQ ID NO:362) on a normal panel.

Expression of *Homo sapiens* fms-related tyrosine kinase 1 (vascular endothelial growth factor/vascular permeability factor receptor) (FLT1) HSFLT transcripts which are detectable by amplicon as depicted in sequence name HSFLT_seg20 (SEQ ID NO:363) in different normal tissues Expression of *Homo sapiens* fms-related tyrosine kinase 1 (vascular endothelial growth factor/vascular permeability factor receptor) (FLT1) transcripts detectable by or according to seg20—HSFLT_seg20 (SEQ ID NO:363) amplicon and primers HSFLT_seg20F (SEQ ID NO:361) and HSFLT_seg20R (SEQ ID NO:362) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (SEQ ID NO:368) (GenBank Accession No. NM_000981 (SEQ ID NO:369); RPL19 (SEQ ID NO:368) amplicon) and TATA (SEQ ID NO:370) box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the placenta samples (sample numbers 30, 31 and 32, Table 5 above), to obtain a value of relative expression of each sample relative to median of the placenta samples. FIG. 5 shows expression of *Homo sapiens* fms-related tyrosine kinase 1 (vascular endothelial growth factor/vascular permeability factor receptor) (FLT1) transcripts detectable by or according to seg20-HSFLT_seg20 (SEQ ID NO:363) amplicon and primers HSFLT_seg20F (SEQ ID NO:361) and HSFLT_seg20R (SEQ ID NO:362) on a normal panel.

Forward Primer (HSFLT_seg20F
(SEQ ID NO: 361)):
GCATAGTTCAGCGTTGCCAAC

Reverse Primer (HSFLT_seg20R
(SEQ ID NO: 362)):
CCATGGCCAAGCTGTATTCA

Amplicon (HSFLT_seg20
(SEQ ID NO: 363)):
GCATAGTTCAGCGTTGCCAACTCATGCTATGCTTTCTAATCATTGTAGA
TGTCTGTGTTCTCTAAATAAGTCAGTTTTCTGTTGGCCAAGAGTTACAT
TATCATGAATGAATACAGCTTGGCCATGG

*Homo sapiens* fms-related tyrosine kinase 1 (vascular endothelial growth factor/vascular permeability factor receptor) (FLT1) transcripts detectable by or according to seg20—HSFLT_seg20 (SEQ ID NO:363) amplicon and primers HSFLT_seg20F (SEQ ID NO:361) and HSFLT_seg20R (SEQ ID NO:362) did not show any differential expression in one experiment carried out with each of the following cancer panels: lung cancer, breast cancer, colon cancer and ovary cancer.

Description for Cluster HSI1RA

Cluster HSI1RA features 4 transcript(s) and 25 segment(s) of interest, the names for which are given in Tables 82 and 83, respectively. The selected protein variants are given in table 84.

TABLE 82

Transcripts of interest

| Transcript Name |
|---|
| HSI1RA_T2 (SEQ ID NO: 61) |
| HSI1RA_T13 (SEQ ID NO: 62) |
| HSI1RA_T16 (SEQ ID NO: 63) |
| HSI1RA_T19 (SEQ ID NO: 64) |

TABLE 83

Segments of interest

| Segment Name |
|---|
| HSI1RA_N13 (SEQ ID NO: 71) |
| HSI1RA_N17 (SEQ ID NO: 73) |
| HSI1RA_N19 (SEQ ID NO: 74) |
| HSI1RA_N20 (SEQ ID NO: 75) |
| HSI1RA_N24 (SEQ ID NO: 78) |
| HSI1RA_N28 (SEQ ID NO: 82) |

TABLE 83-continued

Segments of interest
Segment Name

HSI1RA_N38 (SEQ ID NO: 89)

HSI1RA_N39 (SEQ ID NO: 90)

HSI1RA_N40 (SEQ ID NO: 91)

HSI1RA_N41 (SEQ ID NO: 92)

HSI1RA_N44 (SEQ ID NO: 95)

HSI1RA_N15 (SEQ ID NO: 72)

HSI1RA_N21 (SEQ ID NO: 76)

HSI1RA_N23 (SEQ ID NO: 77)

HSI1RA_N25 (SEQ ID NO: 79)

HSI1RA_N26 (SEQ ID NO: 80)

HSI1RA_N27 (SEQ ID NO: 81)

HSI1RA_N29 (SEQ ID NO: 83)

HSI1RA_N30 (SEQ ID NO: 84)

HSI1RA_N31 (SEQ ID NO: 85)

HSI1RA_N35 (SEQ ID NO: 86)

HSI1RA_N36 (SEQ ID NO: 87)

HSI1RA_N37 (SEQ ID NO: 88)

HSI1RA_N42 (SEQ ID NO: 93)

HSI1RA_N43 (SEQ ID NO: 94)

TABLE 84

Proteins of interest

| Protein Name | Corresponding Transcript(s) |
|---|---|
| HSI1RA_P5 (SEQ ID NO: 65) | HSI1RA_T13 (SEQ ID NO: 62); HSI1RA_T16 (SEQ ID NO: 63) |
| HSI1RA_P6 (SEQ ID NO: 66) | HSI1RA_T16 (SEQ ID NO: 63) |
| HSI1RA_P13 (SEQ ID NO: 67) | HSI1RA_T13 (SEQ ID NO: 62) |
| HSI1RA_P14 (SEQ ID NO: 68) | HSI1RA_T2 (SEQ ID NO: 61) |
| HSI1RA_P16 (SEQ ID NO: 69) | HSI1RA_T19 (SEQ ID NO: 64) |
| HSI1RA_P17 (SEQ ID NO: 70) | HSI1RA_T19 (SEQ ID NO: 64) |

These sequences are variants of the known protein Interleukin-1 receptor antagonist protein precursor (SwissProt accession identifier IL1X_HUMAN (SEQ ID NO: 372); known also according to the synonyms IL-1ra; IRAP; IL1 inhibitor; IL-1RN; ICIL-1RA), referred to herein as the previously known protein.

Protein Interleukin-1 receptor antagonist protein precursor inhibits the activity of IL-1 by binding to its receptor. Protein Interleukin-1 receptor antagonist protein precursor localization is believed to be Secreted for isoform 1; and Cytoplasmic for isoforms 2, 3 and 4.

The known Interleukin-1 receptor antagonist protein also has the following indication(s) and/or potential therapeutic use(s): Arthritis, osteo; Arthritis, rheumatoid; Asthma; Inflammation, general; Inflammatory bowel disease; Transplant rejection, bone marrow; Unspecified. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Interleukin 1 receptor antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antiallergic, non-asthma; Antiarthritic, immunological; Antiasthma; Cytokine; Formulation, conjugate, pegylated; GI inflammatory/bowel disorders; Immunosuppressant; Recombinant interleukin.

According to optional embodiments of the present invention, variants of this cluster according to the present invention (amino acid and/or nucleic acid sequences of HSI1RA) may optionally have one or more of the following utilities, as described with regard to the Table 85 below. It should be noted that these utilities are optionally and preferably suitable for human and non-human animals as subjects, except where otherwise noted. The reasoning is described with regard to biological and/or physiological and/or other information about the known protein, but is given to demonstrate particular diagnostic utility for the variants according to the present invention.

TABLE 85 of Utilities for Variants of HSI1RA, related to Interleukin-1 receptor antagonist protein precursor

| Dx field | Explanation | Ref |
|---|---|---|
| Prediction of response to enteracept in rheumatoid arthritis patients: Theranostics | Genetic polymorphisms, which may influence the balance of IL1RA expression, are associated non-responsiveness (p < 0.05) to etanercept (TNF blocking agent) treatment | Ann Rheum Dis. June 2003; 62(6):526-9. |

TABLE 85-continued of Utilities for Variants of HSI1RA, related to Interleukin-1 receptor antagonist protein precursor

| Dx field | Explanation | Ref |
| --- | --- | --- |
| A surrogate marker for treatment with a combination of infliximab and methotrexate. | Treatment with a combination of infliximab and methotrexate reduces TMJ (temporomandibular joint) pain in RA in association with an increase in IL-1ra in synovial fluid and plasma. | Cells Tissues Organs. 2005; 180(1):22-30 |
| Over expressed in lung cancer metastasis | Significance: 7E–8 | Proc Natl Acad Sci U.S.A. Nov. 20, 2001; 98(24):13790-5. |

According to other optional embodiments of the present invention, variants of this cluster according to the present invention (amino acid and/or nucleic acid sequences of HSI1RA) may optionally have one or more of the following utilities: this marker could be used as a surrogate marker for determining the efficacy of treatment for acute and chronic interleukin-1 (IL-1)-mediated inflammatory diseases, including but not limited to the following: autoimmune diseases; acute pancreatitis; ALS (Amyotrophic Lateral Sclerosis, also known as Lou Gehrig's Disease); Alzheimer's disease; cachexia/anorexia; asthma; atherosclerosis; chronic fatigue syndrome, fever; diabetes (e.g., insulin-dependent diabetes); glomerulonephritis; graft versus host rejection; hemorrhagic shock; hyperalgesia, inflammatory bowel disease; inflammatory conditions of a joint including osteoarthritis, psoriatic arthritis and rheumatoid arthritis; ischemic injury, including cerebral ischemia (e.g., brain injury as a result of trauma, epilepsy, hemorrhage or stroke, each of which may lead to neurodegeneration); lung diseases (e.g., ARDS (adult respiratory distress syndrome)); multiple myeloma; multiple sclerosis; myelogenous leukemia (e.g., AML (Acute Myelogenous Leukemia) and CML (Chronic Myelogenous Leukemia)) and other leukemias; myopathies (e.g., muscle protein metabolism, especially in sepsis); osteoporosis; Parkinson's disease; chronic pain; pre-term labor; psoriasis; reperfusion injury; septic shock; side effects from radiation therapy, temporal mandibular joint disease, tumor metastasis; or an inflammatory condition resulting from strain, sprain, cartilage damage, trauma, orthopedic surgery, infection or other disease processes.

It is suitable as a surrogate marker because it has been shown to be able to block the IL1 receptor in PCT Application No. WO 05/019259 and hence its presence is clearly related to the mechanism of action of IL1 and its receptor in the body.

According to other optional embodiments of the present invention, variants of this cluster according to the present invention (amino acid and/or nucleic acid sequences of HSI1RA) may optionally be used as a theranostic, measured in subjects prior treatment in order to predict the response to the treatment. It may be measured in various subjects undergoing different IL1-related treatments, such as hydroxychloroquine (plaquenil), sulfasalazine, methotrexate, leflunomide (Arava), less commonly used DMARDS include azathioprine, D-penicillamine, gold salts, minocycline and cyclosporine, NSAIDS (COX-2 Inhibitors), biologic agents (etanercept (Enbrel), infliximab (Remicade) and Anakinra), or no treatment, to determine whether there is a correlation between the efficacy of various treatments and the level of IL1-Ra splice variants in the body.

According to other optional embodiments of the present invention, variants of this cluster according to the present invention (amino acid and/or nucleic acid sequences of HSI1RA) may optionally have one or more of the following utilities, some of which are related to utilities described above. It should be noted that these utilities are optionally and preferably suitable for human and non-human animals as subjects, except where otherwise noted.

There is a large body of evidence currently available which supports the role of IL-1 as a major mediator of the systemic response to diseases such as sepsis and pancreatitis and as an activator of the remaining members of the cytokine cascade (Dinarello CA 1994 FASEB J 8:1314-1325).

Because IL-1 is involved in the body's response to inflammation, it is not surprising that excessive production or activity of IL-1 can lead to inflammatory diseases. A non-exclusive list of acute and chronic interleukin-1 (IL-1)-mediated inflammatory diseases includes but is not limited to the following: autoimmune diseases; acute pancreatitis; ALS (Amyotrophic Lateral Sclerosis, also known as Lou Gehrig's Disease); Alzheimer's disease; cachexia/anorexia; asthma; atherosclerosis; chronic fatigue syndrome, fever; diabetes (e.g., insulin-dependent diabetes); glomerulonephritis; graft versus host rejection; hemorrhagic shock; hyperalgesia, inflammatory bowel disease; inflammatory conditions of a joint including osteoarthritis, psoriatic arthritis and rheumatoid arthritis; ischemic injury, including cerebral ischemia (e.g., brain injury as a result of trauma, epilepsy, hemorrhage or stroke, each of which may lead to neurodegeneration); lung diseases (e.g., ARDS (adult respiratory distress syndrome)); multiple myeloma; multiple sclerosis; myelogenous leukemia (e.g., AML (Acute Myelogenous Leukemia) and CML (Chronic Myelogenous Leukemia)) and other leukemias; myopathies (e.g., muscle protein metabolism, especially in sepsis); osteoporosis; Parkinson's disease; chronic pain; pre-term labor; psoriasis; reperfusion injury; septic shock; side effects from radiation therapy, temporal mandibular joint disease, tumor metastasis; or an inflammatory condition resulting from strain, sprain, cartilage damage, trauma, orthopedic surgery, infection or other disease processes.

In normal homeostasis, the actions of IL-1 are maintained in balance by IL-1ra, other natural IL-1 inhibitors (IL-1RII, circulating soluble IL-1RI and IL-1RII) and a network of anti-inflammatory cytokines. However, in rheumatoid arthritis, an imbalance exists in which IL-1 is present in the synovial fluid at a rate 9 times higher than IL-1ra. This imbalance favors agonist-derived inflammation and destruction. Therefore, clinical implications for an imbalance between IL-1 and IL-1Ra include but are not limited to, rheumatoid arthritis, asthma, inflammatory bowel disease, transplant rejection, and bone marrow transplantation. It is also believed that this imbalance may be implicated in cancers such as leukemias and myelomas, and possibly also in arteriosclerosis, Alzheimer's disease and septic shock.

U.S. Pat. No. 6,599,873, hereby incorporated by reference as if fully set forth herein, describes a number of pathological conditions associated with IL-1 production. For example, again without wishing to be limited by a single hypothesis, IL-1 may increase the level of collagenase in an arthritic joint, as well as being potentially involved in immunopathology of rheumatoid arthritis. IL-1 may alter endothelial cell function and thereby cause the migration of leukocytes and lymphocytes into the synovial tissue, as well as causing macrophages to accumulate in the synovial lining. In addition, IL-1 may cause capillary growth and vascularization. IL-1 may also be at least partially responsible for tissue damage in rheumatoid arthritis, by stimulating release of enzymes from fibroblasts and chondrocytes.

IL-1 may also be associated with damage and/or pathological functioning in various types of arthritis. Excessive IL-1 production has been demonstrated in the skin of patients with psoriasis and high levels of IL-1 can be found in the synovial fluid of patients with psoriatic arthritis. IL-1 released by cells in the inflamed synovium in psoriatic arthritis may mediate tissue destruction through stimulation of enzyme release from other cells. The joint pathology of Reiter's syndrome is similar to that seen in psoriatic arthritis and in rheumatoid arthritis. IL-1 has been implicated as a mediator of tissue destruction in these three different forms of inflammatory arthritis. Moreover, IL-1 may be found in the synovial fluid of patients with osteoarthritis. The release of IL-1 by chondrocytes has been implicated in the destruction of articular cartilage in this disease.

IL-1 may also increase the severity of autoimmune diseases. For example, decreased IL-1 production has been described from peripheral blood cells in persons suffering from systemic lupus erythematosus. Moreover, some of the alterations in B lymphocyte function may be related to abnormalities in IL-1 production or IL-1 availability.

Excessive IL-1 production has been demonstrated in the peripheral monocytes of patients with scleroderma, and IL-1 has been implicated as a possible agent of fibrosis through stimulation of collagen production by fibroblasts. The mechanism of tissue damage in dermatomyositis might also involve cell-mediated immunity and IL-1 may therefore be involved as a mediator in this pathophysiological process.

Acute and chronic interstitial lung disease is characterized by excessive collagen production by lung fibroblasts which may be stimulated by IL-1. Recent studies on an animal model of pulmonary hypertension indicate that IL-1 may be responsible for induction of endothelial cell changes that result in narrowing of pulmonary arteries. It is this narrowing that leads to pulmonary hypertension and further secondary damage. Thus, IL-1 inhibitors could be useful in treating these lung diseases.

Recent studies have described that IL-1 is capable of directly damaging the beta cells in the Islets of Langerhans that are responsible for the production of insulin. IL-1 damage to the cells is now hypothesized to be a primary event in the acute phase of juvenile diabetes mellitus.

Monocyte and macrophage infiltration in the kidneys predominates in many forms of acute and chronic glomerulonephritis. IL-1 release by these cells may result in local accumulation of other inflammatory cells, eventually leading to inflammatory damage and fibrotic reaction in the kidneys.

It has been demonstrated that the crystals found in tissues or fluids in gout or pseudogout can directly stimulate macrophages to release IL-1. Thus, IL-1 may be an important mediator in the inflammatory cycle in these diseases.

IL-1 is one of the important endocenous pyrogens and may be responsible for inducing the marked decree of fever seen in some infectious diseases such as acute febrile illnesses due to bacteria or viruses.

Sarcoidosis is characterized by granulomatous lesions in many different organs in the body. IL-1 has been shown to be capable of inducing granuloma formation in vitro and may be involved in this process in patients with sarcoidosis.

Excessive IL-1 production has been demonstrated in peripheral monocytes from both Crohn's disease and ulcerative colitis. Local IL-1 release in the intestine may be an important mediator in stimulating the inflammatory cycle in these diseases.

Certain lymphomas are characterized by fever, osteoporosis and even secondary arthritis. Excessive IL-1 release has been demonstrated by some lymphoma cells in vitro and may be responsible for some of the clinical manifestations of these malignancies. Also, IL-1 production by some malignant lymphocytes may be responsible for some of the fever, acute phase response and cachexia seen with leukemias.

IL-1 release by astrocytes in the brain is thought to be responsible for inducing the fibrosis that may result after damage to the brain from vascular occlusion.

These findings have also been supported in animal models. For example, IL-1ra deficient mice spontaneously develop autoimmune diseases similar to R.A (rheumatoid arthritis) and arthritis Immune colitis in rabbits depends on production of IL-1 and is ameliorated by exogenous administration of IL-1Ra.

Unfortunately, IL-1Ra itself has a number of drawbacks as a therapeutic molecule. For example, a large excess of IL-1Ra is required to block the effect of IL-1. The antagonist has a short (6 hours) half-life in blood plasma. Also, daily injections are required to sustain a therapeutic effect.

Since as described herein above, interleukin-1 is involved in many pathological conditions, and since IL-1Ra itself is deficient as a therapeutic protein, various modes of inactivation of IL-1, together with advanced methods of applications thereof are therefore required for the treatment of different IL-1 mediated diseases.

U.S. Pat. Nos. 5,747,444 and 5,817,306 describe a method for treating graft versus host disease by administering a recombinant IL-Ra; although such treatment may be effective from the point of view of the biological mechanism, as noted above such treatment has many practical barriers to actual clinical efficacy.

U.S. Pat. No. 5,872,095 discloses a method for reducing reperfusion injury, as well as methods for inhibiting IL-1 induced expression of a leukocyte adhesion molecule by endothelial cells, treating disease states resulting from IL-1 induced adhesion of leukocytes to endothelial cells, and treating arthritis, all by administering a specific type of IL-1 Ra variant.

U.S. Pat. No. 6,159,460 describes the use of the wild type IL-1 receptor antagonist for treatment of reperfusion injury. Thus, different types of IL-1 Ra variants may be expected to be useful for the treatment of reperfusion injury.

U.S. Pat. No. 6,027,712 describes localized treatment of inflamed mucosal tissue lining a cavity with the ear, nose or sinus with IL-1Ra using a special formulation of aerosol.

U.S. Pat. No. 5,747,072 describes a method of reducing an inflammatory response in a joint by administering to the joint a recombinant adenoviral vector comprising an expression control sequence operatively linked to a gene that encodes an IL-1 receptor antagonist, and expressing said IL-1Ra at a level sufficient to reduce an inflammatory response in said joint. U.S. Pat. No. 6,096,728 provides pharmaceutical compositions comprising synergistic amounts of a hyaluronan or a salt thereof, and an IL-1Ra.

The level of IL-1 receptor antagonist within a cell or a tissue may also have diagnostic value, for example by diagnosing endometrial cancer by measuring the amount of intracellular IL-1Ra present in endometrial cells from a patient suspected of having said cancer, and comparing the amount to that present in normal endothelial cells is disclosed in U.S. Pat. No. 5,840,496. Methods for diagnosing diseases resulting from undesirable cell adhesion of IL-1 receptor positive cells to biological material, particular to endothelial cells, or autoimmune related diseases, or IL-1 dependent cancer by measuring the amount of intracellular IL-1Ra present are disclosed in U.S. Pat. No. 5,814,469.

According to other optional embodiments of the present invention, variants of HSI1RA cluster according to the present invention (amino acid and/or nucleic acid sequences of HSI1RA) may optionally have one or more of the diagnostic utilities, for example by diagnosing IL-1 related disease or disorder.

According to yet another embodiment, the IL-1 related disease or disorder is selected from the group consisting of acute pancreatitis; ALS; Alzheimer's disease; cachexia/anorexia; asthma; atherosclerosis; chronic fatigue syndrome; diabetes (e.g., insulin diabetes); glomerulonephritis; graft versus host rejection; hemorrhagic shock; hyperalgesia, inflammatory bowel disease; inflammatory conditions of a joint including osteoarthritis, psoriatic arthritis and rheumatoid arthritis; ischemic injury, including cerebral ischemia (e.g., brain injury as a result of trauma, epilepsy, hemorrhage or stroke, each of which may lead to neurodegeneration); lung diseases (e.g., ARDS); multiple myeloma; multiple sclerosis; myelogenous (e.g., AML and CML) and other leukemias; myopathies (e.g., muscle protein metabolism, specifically in sepsis); osteoporosis; Parkinson's disease; chronic pain; pre-term labor; psoriasis; reperfusion injury; septic shock; side effects from radiation therapy, temporal mandibular joint disease, tumor metastasis; or an inflammatory condition resulting from strain, sprain, cartilage damage, trauma, orthopedic surgery, or infection.

A non-limiting example of such a utility of variants of HSI1RA cluster according to the present invention (amino acid and/or nucleic acid sequences of HSI1RA) is detection of brain injury and myocardial infraction, as described for example in US patent application number 20030109420 (hereby incorporated by reference as if fully set forth herein) with regard to the known protein, IL1-Ra. The non-acute stage optionally and preferably includes (but is not limited to) asymptomatic coronary artery disease or stable angina, while the acute stage optionally and preferably includes (but is not limited to) unstable angina and acute myocardial infarction.

Another non-limiting example of such a utility of variants of HSI1RA cluster according to the present invention (amino acid and/or nucleic acid sequences of HSI1RA) is diagnosis and evaluation of stroke and transient ischemic attacks, as described for example in US patent application number 20040219509 (hereby incorporated by reference as if fully set forth herein) with regard to the known protein, IL1-Ra.

Other non-limiting exemplary utilities for HSI1RA variants according to the present invention are described in greater detail below and also with regard to the previous section on clinical utility.

As noted above, cluster HSI1RA features 4 transcript(s), which were listed in Table 82 above. These transcript(s) encode for protein(s) which are variant(s) of protein Interleukin-1 receptor antagonist protein precursor. A description of each variant protein according to the present invention is now provided.

Variant protein HSI1RA_P5 (SEQ ID NO:65) according to the present invention has an amino acid sequence as given at the end of the application; it is encoded by transcript(s) HSI1RA_T13 (SEQ ID NO:62) and HSI1RA_T16 (SEQ ID NO:63). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P5 (SEQ ID NO:65) and IL1X_HUMAN (SEQ ID NO: 372):

A. An isolated chimeric polypeptide as set forth in HSI1RA_P5 (SEQ ID NO:65), comprising a first amino acid sequence being at least 90% homologous to MQAFRIWDVNQKTFYLRNNQLVAGYLQGPNVNLE corresponding to amino acids 35-68 of IL1X_HUMAN (SEQ ID NO: 372), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

B. An isolated polypeptide encoding for an edge portion of HSI1RA_P5 (SEQ ID NO:65), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P5 (SEQ ID NO:65).

2. Comparison report between HSI1RA_P5 (SEQ ID NO:65) and NP_776215 (SEQ ID NO: 535):

A. An isolated chimeric polypeptide as set forth in HSI1RA_P5 (SEQ ID NO:65), comprising a first amino acid sequence being at least 90% homologous to MQAFRIWDVNQKTFYLRNNQLVAGYLQGPNVNLE corresponding to amino acids 1-34 of NP_776215 (SEQ ID NO: 535), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

B. An isolated polypeptide encoding for an edge portion of HSI1RA_P5 (SEQ ID NO:65), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P5 (SEQ ID NO:65).

3. Comparison report between HSI1RA_P5 (SEQ ID NO:65) and NP_000568 (SEQ ID NO: 532):

A. An isolated chimeric polypeptide as set forth in HSI1RA_P5 (SEQ ID NO:65), comprising a first amino acid sequence being at least 90% homologous to MQAFRIWDVNQKTFYLRNNQLVAGYLQGPNVNLE corresponding to amino acids 17-50 of NP_000568 (SEQ ID NO: 532), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

4. Comparison report between HSI1RA_P5 (SEQ ID NO:65) and NP_776213 (SEQ ID NO: 533):

A. An isolated chimeric polypeptide as set forth in HSI1RA_P5 (SEQ ID NO:65), comprising a first amino acid sequence being at least 90% homologous to MQAFRIWD-VNQKTFYLRNNQLVAGYLQGPNVNLE corresponding to amino acids 38-71 of NP_776213 (SEQ ID NO: 533), which also corresponds to amino acids 1-34 of HSI1RA_P5 (SEQ ID NO:65), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 35-64 of HSI1RA_P5 (SEQ ID NO:65), wherein said first amino acid sequence and second amino acid sequence are contiguous and in a sequential order.

The location of the variant protein was determined according to results from a number of different software programs and analyses, including analyses from SignalP and other specialized programs. The variant protein is intracellular.

Variant protein HSI1RA_P5 (SEQ ID NO:65) also has the following non-silent SNPs (Single Nucleotide Polymorphisms) as listed in Table 86, (given according to their position(s) on the amino acid sequence, with the alternative amino acid(s) listed; the presence of known SNPs in variant protein HSI1RA_P5 (SEQ ID NO:65) sequence provides support for the deduced sequence of this variant protein according to the present invention).

TABLE 86

Amino acid mutations

| SNP position(s) on amino acid sequence | Alternative amino acid(s) |
| --- | --- |
| 20 | Q -> * |
| 42 | P -> S |
| 43 | M -> T |
| 45 | V -> L |

The glycosylation sites of variant protein HSI1RA_P5 (SEQ ID NO:65), as compared to the known protein Interleukin-1 receptor antagonist protein precursor, are described in Table 87 (given according to their position(s) on the amino acid sequence in the first column; the second column indicates whether the glycosylation site is present in the variant protein; and the last column indicates whether the position is different on the variant protein).

TABLE 87

Glycosylation site(s)

| Position(s) on known amino acid sequence | Present in variant protein? | Position(s) on variant protein |
| --- | --- | --- |
| 109 | No | |

The variant protein has the following domains, as determined by using InterPro. The domains are described in Table 88:

TABLE 88

InterPro domain(s)

| Domain description | Analysis type | Position(s) on protein |
| --- | --- | --- |
| Interleukin-1 | BlastProDom | 1-34 |

Variant protein HSI1RA_P5 (SEQ ID NO:65) is encoded by the following transcript(s): HSI1RA_T13 (SEQ ID NO:62) and HSI1RA_T16 (SEQ ID NO:63), for which the coding portion starts at position 203 and ends at position 394. The transcript also has the following SNPs as listed in Table 89 (given according to their position on the nucleotide sequence, with the alternative nucleic acid listed; the presence of known SNPs in variant protein HSI1RA_P5 (SEQ ID NO:65) sequence provides support for the deduced sequence of this variant protein according to the present invention).

TABLE 89

Nucleic acid SNPs

| Polymorphism | SNP position(s) on nucleotide sequence |
| --- | --- |
| G -> A | 68, 169, 337, 440, 463, 1529, 2014, 2325, 2978 |
| A -> G | 124, 736, 867, 1621 |
| G -> C | 143, 335, 358, 1534 |
| C -> T | 260, 326, 481, 547, 1643, 1783, 756, 1939, 1945, 2081, 2176 |
| T -> C | 271, 330, 437, 1870, 1913, 2324 |
| T -> G | 399, 2533, 2641 |
| A -> C | 402, 574, 1199, 1988, 2398 |
| C -> A | 413, 784 |
| G -> T | 522 |
| C -> G | 868, 2069, 2089, 2152 |
| C -> A | 868, 1198 |
| -> T | 1787 |
| C -> | 1846, 2069 |
| T -> | 2504, 2705, 2635 |

The coding portion of transcript HSI1RA_T16 (SEQ ID NO:63) starts at position 478 and ends at position 669. The transcript also has the following SNPs as listed in Table 90 (given according to their position on the nucleotide sequence, with the alternative nucleic acid listed; the presence of known SNPs in variant protein HSI1RA_P5 (SEQ ID NO:65) sequence provides support for the deduced sequence of this variant protein according to the present invention).

TABLE 90

Nucleic acid SNPs

| Polymorphism | SNP position(s) on nucleotide sequence |
| --- | --- |
| C -> G | 40, 1143, 2344, 2364, 2427 |
| C -> T | 268, 535, 601, 756, 822, 1031, 1918, 2058, 2214, 2220, 2356, 2451 |
| G -> A | 304, 444, 612, 715, 738, 1804, 2289, 2600, 3253 |
| T -> C | 546, 605, 712, 2145, 2599, 2188 |
| G -> C | 610, 633, 1809 |
| T -> G | 674, 2808, 2916 |
| A -> C | 677, 849, 1474, 2263, 2673 |
| C -> A | 688, 1059, 1143, 1473 |
| G -> T | 797 |
| A -> G | 1011, 1142, 1896 |
| -> T | 2062 |
| C -> | 2121, 2344 |
| T -> | 2779, 2910, 2980 |

Variant protein HSI1RA_P6 (SEQ ID NO:66) according to the present invention has an amino acid sequence as given at the end of the application; it is encoded by transcript(s) HSI1RA_T16 (SEQ ID NO:63). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P6 (SEQ ID NO:66) and IL1X_HUMAN (SEQ ID NO: 372):

A. An isolated chimeric polypeptide as set forth in HSI1RA_P6 (SEQ ID NO:66), comprising a first amino acid sequence being at least 90% homologous to MEICRGLRSHLITLLLFLFHSETICRPSGRKSSKMQAFRIWDVNQKTFYLRNNQLVAGYLQGPNVNLE corresponding to amino acids 1-68 of IL1X_HUMAN (SEQ ID NO: 372), which also corresponds to amino acids 1-68 of HSI1RA_P6 (SEQ ID NO:66), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence and second amino acid sequence are contiguous and in a sequential order.

B. An isolated polypeptide encoding for an edge portion of HSI1RA_P6 (SEQ ID NO:66), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P6 (SEQ ID NO:66).

2. Comparison report between HSI1RA_P6 (SEQ ID NO:66) and P18510-2 (SEQ ID NO:373):

A. An isolated chimeric polypeptide as set forth in HSI1RA_P6 (SEQ ID NO:66), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P6 (SEQ ID NO:66), a second amino acid sequence being at least 90% homologous to ETICRPSGRKSSKMQAFRIWDVNQKTFYLRNNQLVAGYLQGPNVNLE corresponding to amino acids 4-50 of P18510-2 (SEQ ID NO:373), which also corresponds to amino acids 22-68 of HSI1A_P6 (SEQ ID NO:66), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence, second amino acid sequence and third amino acid sequence are contiguous and in a sequential order.

B. An isolated polypeptide encoding for a head of HSI1RA_P6 (SEQ ID NO:66), comprising a polypeptide being at least 70%, optionally at least about 80%, preferably at least about 85%, more preferably at least about 90% and most preferably at least about 95% homologous to the sequence MEICRGLRSHLITLLLFLFHS (SEQ ID NO: 578) of HSI1RA_P6 (SEQ ID NO:66).

3. Comparison report between HSI1RA_P6 (SEQ ID NO:66) and NP_776213 (SEQ ID NO: 533):

A. An isolated chimeric polypeptide as set forth in HSI1RA_P6 (SEQ ID NO:66), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P6 (SEQ ID NO:66), a second amino acid sequence being at least 90% homologous to ETICRPSGRKSSKMQAFRIWDVNQKTFYLRNNQLVAGYLQGPNVNLE corresponding to amino acids 25-71 of NP_776213 (SEQ ID NO: 533), which also corresponds to amino acids 22-68 of HSI1RA_P6 (SEQ ID NO:66), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence, second amino acid sequence and third amino acid sequence are contiguous and in a sequential order.

4. Comparison report between HSI1RA_P6 (SEQ ID NO:66) and P18510-4 (SEQ ID NO:375):

A. An isolated chimeric polypeptide as set forth in HSI1A_P6 (SEQ ID NO:66), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHSETICRPSGRKSSK (SEQ ID NO: 579) corresponding to amino acids 1-34 of HSI1RA_P6 (SEQ ID NO:66), a second amino acid sequence being at least 90% homologous to MQAFRIWDVNQKTFYLRNNQLVAGYLQGPNVNLE corresponding to amino acids 1-34 of P18510-4 (SEQ ID NO:375), which also corresponds to amino acids 35-68 of HSI1RA_P6 (SEQ ID NO:66), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 69-98 of HSI1RA_P6 (SEQ ID NO:66), wherein said first amino acid sequence, second amino acid sequence and third amino acid sequence are contiguous and in a sequential order.

B. An isolated polypeptide encoding for a head of HSI1RA_P6 (SEQ ID NO:66), comprising a polypeptide being at least 70%, optionally at least about 80%, preferably at least about 85%, more preferably at least about 90% and most preferably at least about 95% homologous to the sequence MEICRGLRSHLITLLLFLFHSETICRPSGRKSSK (SEQ ID NO: 579) of HSI1RA_P6 (SEQ ID NO:66).

The location of the variant protein was determined according to results from a number of different software programs and analyses, including analyses from SignalP and other specialized programs. The variant protein is secreted.

Variant protein HSI1RA_P6 (SEQ ID NO:66) also has the following non-silent SNPs (Single Nucleotide Polymorphisms) as listed in Table 91, (given according to their position(s) on the amino acid sequence, with the alternative amino acid(s) listed; the presence of known SNPs in variant protein HSI1RA_P6 (SEQ ID NO:66) sequence provides support for the deduced sequence of this variant protein according to the present invention).

TABLE 91

Amino acid mutations

| SNP position(s) on amino acid sequence | Alternative amino acid(s) |
|---|---|
| 54 | Q -> * |
| 76 | P -> S |
| 77 | M -> T |
| 79 | V -> L |

The glycosylation sites of variant protein HSI1RA_P6 (SEQ ID NO:66), as compared to the known protein Interleukin-1 receptor antagonist protein precursor, are described in Table 92 (given according to their position(s) on the amino acid sequence in the first column; the second column indicates whether the glycosylation site is present in the variant protein; and the last column indicates whether the position is different on the variant protein).

TABLE 92

Glycosylation site(s)

| Position(s) on known amino acid sequence | Present in variant protein? | Position(s) on variant protein |
|---|---|---|
| 109 | No | |

The variant protein has the following domains, as determined by using InterPro. The domains are described in Table 93:

TABLE 93

InterPro domain(s)

| Domain description | Analysis type | Position(s) on protein |
|---|---|---|
| Interleukin-1 | BlastProDom | 33-68 |
| Interleukin-1 receptor antagonist IL1RA | FPrintScan | 34-54, 55-75 |

Variant protein HSI1RA_P6 (SEQ ID NO:66) is encoded by the following transcript(s): HSI1RA_T16 (SEQ ID NO:63), for which the coding portion starts at position 376 and ends at position 669. The transcript also has the following SNPs as listed in Table 94 (given according to their position on the nucleotide sequence, with the alternative nucleic acid listed; the presence of known SNPs in variant protein HSI1RA_P6 (SEQ ID NO:66) sequence provides support for the deduced sequence of this variant protein according to the present invention).

TABLE 94

Nucleic acid SNPs

| Polymorphism | SNP position(s) on nucleotide sequence |
|---|---|
| C -> G | 40, 1143, 2344, 2364, 2427 |
| C -> T | 268, 535, 601, 756, 822, 1031, 1918, 2058, 2214, 2451, 2220, 2356 |
| G -> A | 304, 612, 444, 715, 738, 1804, 2289, 2600, 3253 |
| T -> C | 546, 605, 712, 2145, 2188, 2599 |
| G -> C | 610, 633, 1809 |
| G -> T | 797 |
| A -> G | 1011, 1142, 1896 |
| -> T | 2062 |
| C -> | 2121, 2344 |
| T -> | 2779, 2910, 2980 |

Variant protein HSI1RA_P13 (SEQ ID NO:67) according to the present invention has an amino acid sequence as given at the end of the application; it is encoded by transcript(s) HSI1RA_T13 (SEQ ID NO:62). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P13 (SEQ ID NO:67) and IL1X_HUMAN (SEQ ID NO: 372):

A. An isolated chimeric polypeptide as set forth in HSI1RA_P13 (SEQ ID NO:67), comprising a first amino acid sequence being at least 70%, optionally at least 80%, preferably at least 85%, more preferably at least 90% and most preferably at least 95% homologous to a polypeptide having the sequence MAL (SEQ ID NO: 580) corresponding to amino acids 1-3 of HSI1RA_P13 (SEQ ID NO:67), a second amino acid sequence being at least 90% homologous to ETICRPSGRKSSKMQAFRIWDVNQKTFYLRN-NQLVAGYLQGPNVNLE corresponding to amino acids 22-68 of IL1X_HUMAN (SEQ ID NO: 372), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

2. Comparison report between HSI1RA_P13 (SEQ ID NO:67) and NP_000568 (SEQ ID NO: 532):

A. An isolated chimeric polypeptide as set forth in HSI1RA_P13 (SEQ ID NO:67), comprising a first amino acid sequence being at least 90% homologous to MALETICRPS-GRKSSKMQAFRIWDVNQKTFYLRN-NQLVAGYLQGPNVNLE corresponding to amino acids 1-50 of NP_000568 (SEQ ID NO: 532), which also corresponds to amino acids 1-50 of HSI1RA_P13 (SEQ ID NO:67), and a second amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence and second amino acid sequence are contiguous and in a sequential order.

3. Comparison report between HSI1RA_P13 (SEQ ID NO:67) and P18510-3 (SEQ ID NO:374):

A. An isolated chimeric polypeptide as set forth in HSI1RA_P13 (SEQ ID NO:67), comprising a first amino acid sequence being at least 90% homologous to MAL (SEQ ID NO: 580) corresponding to amino acids 1-3 of P18510-3 (SEQ ID NO:374), which also corresponds to amino acids 1-3 of HSI1RA_P13 (SEQ ID NO:67), a second amino acid sequence being at least 90% homologous to ETICRPS-GRKSSKMQAFRIWDVNQKTFYLRN-NQLVAGYLQGPNVNLE corresponding to amino acids 25-71 of P18510-3 (SEQ ID NO:374), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKP- MYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

B. An isolated chimeric polypeptide encoding for an edge portion of HSI1RA_P13 (SEQ ID NO:67), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LE, having a structure as follows: a sequence starting from any of amino acid numbers 3−x to 3; and ending at any of amino acid numbers 4+((n−2)−x), in which x varies from 0 to n−2.

C. An isolated polypeptide encoding for an edge portion of HSI1RA_P13 (SEQ ID NO:67), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P13 (SEQ ID NO:67).

4. Comparison report between HSI1RA_P13 (SEQ ID NO:67) and NP_776214 (SEQ ID NO: 534):

A. An isolated chimeric polypeptide as set forth in HSI1RA_P13 (SEQ ID NO:67), comprising a first amino acid sequence being at least 70%, optionally at least 80%, preferably at least 85%, more preferably at least 90% and most preferably at least 95% homologous to a polypeptide having the sequence MAL (SEQ ID NO: 580) corresponding to amino acids 1-3 of HSI1RA_P13 (SEQ ID NO:67), a second amino acid sequence being at least 90% homologous to ETICRPSGRKSSKMQAFRIWDVNQKTFYLRNNQLVAGYLQGPNVNLE corresponding to amino acids 22-68 of NP_776214 (SEQ ID NO: 534), which also corresponds to amino acids 4-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

5. Comparison report between HSI1RA_P13 (SEQ ID NO:67) and P18510-4 (SEQ ID NO:375):

A. An isolated chimeric polypeptide as set forth in HSI1RA_P13 (SEQ ID NO:67), comprising a first amino acid sequence being at least 70%, optionally at least 80%, preferably at least 85%, more preferably at least 90% and most preferably at least 95%, homologous to a polypeptide having the sequence MALETICRPSGRKSSK (SEQ ID NO: 581) corresponding to amino acids 1-16 of HSI1RA_P13 (SEQ ID NO:67), a second amino acid sequence being at least 90% homologous to MQAFRIWDVNQKTFYLRNNQLVAGYLQGPNVNLE corresponding to amino acids 1-34 of P18510-4 (SEQ ID NO:375), which also corresponds to amino acids 17-50 of HSI1RA_P13 (SEQ ID NO:67), and a third amino acid sequence being at least 70%, optionally at least 80%, preferably at least 85%, more preferably at least 90% and most preferably at least 95% homologous to a polypeptide having the sequence GEWLPGKPMYVGITSLCPSVCSSMACLHKP (SEQ ID NO: 474) corresponding to amino acids 51-80 of HSI1RA_P13 (SEQ ID NO:67), wherein said first amino acid sequence, second amino acid sequence and third amino acid sequence are contiguous and in a sequential order.

B. An isolated polypeptide encoding for a head of HSI1RA_P13 (SEQ ID NO:67), comprising a polypeptide being at least 70%, optionally at least about 80%, preferably at least about 85%, more preferably at least about 90% and most preferably at least about 95% homologous to the sequence MALETICRPSGRKSSK (SEQ ID NO: 581) of HSI1RA_P13 (SEQ ID NO:67).

C. An isolated polypeptide encoding for an edge portion of HSI1RA_P13 (SEQ ID NO:67), comprising an amino acid sequence being at least 70%, optionally at least about 80%, preferably at least about 85%, more preferably at least about 90% and most preferably at least about 95% homologous to the sequence GEWLPGKPMYVGITSLCPSVCSSMACLHKP (SEQ ID NO: 474) of HSI1RA_P13 (SEQ ID NO:67).

The location of the variant protein was determined according to results from a number of different software programs and analyses, including analyses from SignalP and other specialized programs. The variant protein is intracellularly.

Variant protein HSI1RA_P13 (SEQ ID NO:67) also has the following non-silent SNPs (Single Nucleotide Polymorphisms) as listed in Table 95, (given according to their position(s) on the amino acid sequence, with the alternative amino acid(s) listed; the presence of known SNPs in variant protein HSI1RA_P13 (SEQ ID NO:67) sequence provides support for the deduced sequence of this variant protein according to the present invention).

TABLE 95

| Amino acid mutations | |
|---|---|
| SNP position(s) on amino acid sequence | Alternative amino acid(s) |
| 36 | Q -> * |
| 58 | P -> S |
| 59 | M -> T |
| 61 | V -> L |

The glycosylation sites of variant protein HSI1RA_P13 (SEQ ID NO:67), as compared to the known protein Interleukin-1 receptor antagonist protein precursor, are described in Table 96 (given according to their position(s) on the amino acid sequence in the first column; the second column indicates whether the glycosylation site is present in the variant protein; and the last column indicates whether the position is different on the variant protein).

TABLE 96

| Glycosylation site(s) | | |
|---|---|---|
| Position(s) on known amino acid sequence | Present in varaint protein | Position(s) on variant protein |
| 109 | No | |

The variant protein has the following domains, as determined by using InterPro. The domains are described in Table 97:

TABLE 97

InterPro domain(s)

| Domain description | Analysis type | Position(s) on protein |
|---|---|---|
| Interleukin-1 | BlastProDom | 15-50 |
| Interleukin-1 receptor antagonist IL1RA | FPrintScan | 16-36, 37-57 |

Variant protein HSI1RA_P13 (SEQ ID NO:67) is encoded by the following transcript(s): HSI1RA_T13 (SEQ ID NO:62), for which the coding portion starts at position 155 and ends at position 394. The transcript also has the following SNPs as listed in Table 98 (given according to their position on the nucleotide sequence, with the alternative nucleic acid listed; the presence of known SNPs in variant protein HSI1RA_P13 (SEQ ID NO:67) sequence provides support for the deduced sequence of this variant protein according to the present invention).

TABLE 98

Nucleic acid SNPs

| Polymorphism | SNP position(s) on nucleotide sequence |
|---|---|
| G -> A | 68, 169, 337, 440, 463, 1529, 2014, 2325, 2978 |
| A -> G | 124, 736, 867, 1621 |
| G -> C | 143, 335, 358, 1534 |
| C -> T | 260, 326, 481, 547, 756, 1643, 1783, 1939, 1945, 2081, 2176 |
| T -> C | 271, 330, 437, 1870, 1913, 2324 |
| T -> G | 399, 2533, 2641 |
| A -> C | 402, 574, 1199, 1988, 2398 |
| C -> A | 413, 784, 868, 1198 |
| G -> T | 522 |
| C -> G | 868, 2069, 2089, 2152 |
| ->T | 1787 |
| C-> | 1846, 2069 |
| T-> | 2504, 2635, 2705 |

Variant protein HSI1RA_P14 (SEQ ID NO:68) according to the present invention has an amino acid sequence as given at the end of the application; it is encoded by transcript(s) HSI1RA_T2 (SEQ ID NO:61). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P14 (SEQ ID NO:68) and NP_776213 (SEQ ID NO: 533):

A. An isolated chimeric polypeptide as set forth in HSI1RA_P14 (SEQ ID NO:68), comprising a first amino acid sequence being at least 90% homologous to MALADLYEEGGGGGGEGEDNADSK corresponding to amino acids 1-24 of NP_776213 (SEQ ID NO: 533), which also corresponds to amino acids 1-24 of HSI1RA_P14 (SEQ ID NO:68), and a second amino acid sequence being at least 70%, optionally at least 80%, preferably at least 85%, more preferably at least 90% and most preferably at least 95% homologous to a polypeptide having the sequence GGL (SEQ ID NO: 477) corresponding to amino acids 25-27 of HSI1RA_P14 (SEQ ID NO:68), wherein said first amino acid sequence and second amino acid sequence are contiguous and in a sequential order.

B. An isolated polypeptide encoding for an edge portion of HSI1RA_P14 (SEQ ID NO:68), comprising an amino acid sequence being at least 70%, optionally at least about 80%, preferably at least about 85%, more preferably at least about 90% and most preferably at least about 95% homologous to the sequence GGL (SEQ ID NO: 477) of HSI1RA_P14 (SEQ ID NO:68).

The location of the variant protein was determined according to results from a number of different software programs and analyses, including analyses from SignalP and other specialized programs. The variant protein is intracellular.

The glycosylation sites of variant protein HSI1RA_P14 (SEQ ID NO:68), as compared to the known protein Interleukin-1 receptor antagonist protein precursor, are described in Table 99 (given according to their position(s) on the amino acid sequence in the first column; the second column indicates whether the glycosylation site is present in the variant protein; and the last column indicates whether the position is different on the variant protein).

TABLE 99

Glycosylation site(s)

| Position(s) on known amino acid sequence | Present in variant protein | Position(s) on variant protein |
|---|---|---|
| 109 | No | |

Variant protein HSI1RA_P14 (SEQ ID NO:68) is encoded by the following transcript(s): HSI1RA_T2 (SEQ ID NO:61), for which the coding portion starts at position 155 and ends at position 235. The transcript also has the following SNPs as listed in Table 100 (given according to their position on the nucleotide sequence, with the alternative nucleic acid listed; the presence of known SNPs in variant protein HSI1RA_P14 (SEQ ID NO:68) sequence provides support for the deduced sequence of this variant protein according to the present invention).

TABLE 100

Nucleic acid SNPs

| Polymorphism | SNP position(s) on nucleotide sequence |
|---|---|
| G -> A | 68, 386, 403, 868, 1179, 1832 |
| A -> G | 124 |
| G -> C | 143 |
| C -> T | 494, 637, 793, 799, 935, 1030 |
| T -> C | 505, 724, 767, 1178 |
| ->T | 641 |
| C-> | 700, 923 |
| A -> C | 842, 1252 |
| C -> G | 923, 943, 1006 |
| T-> | 1358, 1489, 1559 |
| T -> G | 1387, 1495 |

Variant protein HSI1RA_P16 (SEQ ID NO:69) according to the present invention has an amino acid sequence as given at the end of the application; it is encoded by transcript(s) HSI1RA_T19 (SEQ ID NO:64). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P16 (SEQ ID NO:69) and IL1X_HUMAN (SEQ ID NO: 372):

A. An isolated chimeric polypeptide as set forth in HSI1RA_P16 (SEQ ID NO:69), comprising a first amino acid sequence being at least 90% homologous to MEICRGLRSHLITLLLFLFHSETICRPSGRKSSKM-QAFRIWDVNQKTFYLRNNQLVAGYLQGPNVNLE corresponding to amino acids 1-68 of IL1X_HUMAN (SEQ ID NO: 372), which also corresponds to amino acids 1-68 of HSI1RA_P16 (SEQ ID NO:69), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence and second amino acid sequence are contiguous and in a sequential order.

B. An isolated polypeptide encoding for an edge portion of HSI1RA_P16 (SEQ ID NO:69), comprising an amino acid sequence being at least 70%, optionally at least about 80%, preferably at least about 85%, more preferably at least about 90% and most preferably at least about 95% homologous to the sequence DRCGTH (SEQ ID NO: 478) of HSI1RA_P16 (SEQ ID NO:69).

2. Comparison report between HSI1RA_P16 (SEQ ID NO:69) and P18510-2 (SEQ ID NO:373):

A. An isolated chimeric polypeptide as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P16 (SEQ ID NO:69), a second amino acid sequence being at least 90% homologous to ETICRPSGRKSSKMQAFRIWDVN-QKTFYLRNNQLVAGYLQGPNVNLE corresponding to amino acids 4-50 of P18510-2 (SEQ ID NO:373), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

B. An isolated polypeptide encoding for a head of HSI1RA_P16 (SEQ ID NO:69), comprising a polypeptide being at least 70%, optionally at least about 80%, preferably at least about 85%, more preferably at least about 90% and most preferably at least about 95% homologous to the sequence MEICRGLRSHLITLLLFLFHS (SEQ ID NO: 578) of HSI1RA_P16 (SEQ ID NO:69).

C. An isolated polypeptide encoding for an edge portion of HSI1RA_P16 (SEQ ID NO:69), comprising an amino acid sequence being at least 70%, optionally at least about 80%, preferably at least about 85%, more preferably at least about 90% and most preferably at least about 95% homologous to the sequence DRCGTH (SEQ ID NO: 478) of HSI1RA_P16 (SEQ ID NO:69).

4. Comparison report between HSI1RA_P16 (SEQ ID NO:69) and NP_776213 (SEQ ID NO: 533):

A. An isolated chimeric polypeptide as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHS (SEQ ID NO: 578) corresponding to amino acids 1-21 of HSI1RA_P16 (SEQ ID NO:69), a second amino acid sequence being at least 90% homologous to ETICRPSGRKSSKMQAFRIWDVN-QKTFYLRNNQLVAGYLQGPNVNLE corresponding to amino acids 25-71 of NP_776213 (SEQ ID NO: 533), which also corresponds to amino acids 22-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

B. An isolated polypeptide encoding for a head of HSI1RA_P16 (SEQ ID NO:69), comprising a polypeptide being at least 70%, optionally at least about 80%, preferably at least about 85%, more preferably at least about 90% and most preferably at least about 95% homologous to the sequence MEICRGLRSHLITLLLFLFHS (SEQ ID NO: 578) of HSI1RA_P16 (SEQ ID NO:69).

5. Comparison report between HSI1RA_P16 (SEQ ID NO:69) and P18510-4 (SEQ ID NO:375):

A. An isolated chimeric polypeptide as set forth in HSI1RA_P16 (SEQ ID NO:69), comprising a first amino acid sequence being at least 70%, optionally at least 80%, preferably at least 85%, more preferably at least 90% and most preferably at least 95%, homologous to a polypeptide having the sequence MEICRGLRSHLITLLLFLFHSETICRPS-GRKSSK (SEQ ID NO: 579) corresponding to amino acids 1-34 of HSI1RA_P16 (SEQ ID NO:69), a second amino acid sequence being at least 90% homologous to MQAFRIWD-VNQKTFYLRNNQLVAGYLQGPNVNLE corresponding to amino acids 1-34 of P18510-4 (SEQ ID NO:375), which also corresponds to amino acids 35-68 of HSI1RA_P16 (SEQ ID NO:69), and a third amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 69-74 of HSI1RA_P16 (SEQ ID NO:69), wherein said first amino acid sequence, second amino acid sequence and third amino acid sequence are contiguous and in a sequential order.

B. An isolated polypeptide encoding for a head of HSI1RA_P16 (SEQ ID NO:69), comprising a polypeptide being at least 70%, optionally at least about 80%, preferably at least about 85%, more preferably at least about 90% and most preferably at least about 95% homologous to the sequence MEICRGLRSHLITLLLFLFHSETICRPS-GRKSSK (SEQ ID NO: 579) of HSI1RA_P16 (SEQ ID NO:69).

The location of the variant protein was determined according to results from a number of different software programs and analyses, including analyses from SignalP and other specialized programs. The variant protein is secreted.

Variant protein HSI1RA_P16 (SEQ ID NO:69) also has the following non-silent SNPs (Single Nucleotide Polymorphisms) as listed in Table 101, (given according to their position(s) on the amino acid sequence, with the alternative amino acid(s) listed; the presence of known SNPs in variant protein HSI1RA_P16 (SEQ ID NO:69) sequence provides support for the deduced sequence of this variant protein according to the present invention).

TABLE 101

| Amino acid mutations | |
|---|---|
| SNP position(s) on amino acid sequence | Alternative amino acid(s) |
| 54 | Q -> * |

The glycosylation sites of variant protein HSI1RA_P16 (SEQ ID NO:69), as compared to the known protein Interleukin-1 receptor antagonist protein precursor, are described in Table 102 (given according to their position(s) on the amino acid sequence in the first column; the second column indicates whether the glycosylation site is present in the variant protein; and the last column indicates whether the position is different on the variant protein).

TABLE 102

| Glycosylation site(s) | | |
| --- | --- | --- |
| Position(s) on known amino acid sequence | Present in variant protein? | Position(s) on variant protein |
| 109 | No | |

The variant protein has the following domains, as determined by using InterPro. The domains are described in Table 103:

TABLE 103

| InterPro domain(s) | | |
| --- | --- | --- |
| Domain description | Analysis type | Position(s) on protein |
| Interleukin-1 | BlastProDom | 33-70 |
| Interleukin-1 receptor antagonist IL1RA | FPrintScan | 34-54, 55-74 |

Variant protein HSI1RA_P16 (SEQ ID NO:69) is encoded by the following transcript(s): HSI1RA_T19 (SEQ ID NO:64), for which the coding portion starts at position 376 and ends at position 597. The transcript also has the following SNPs as listed in Table 104 (given according to their position on the nucleotide sequence, with the alternative nucleic acid listed; the presence of known SNPs in variant protein HSI1RA_P16 (SEQ ID NO:69) sequence provides support for the deduced sequence of this variant protein according to the present invention).

TABLE 104

| Nucleic acid SNPs | |
| --- | --- |
| Polymorphism | SNP position(s) on nucleotide sequence |
| C -> G | 40, 959, 979, 1042 |
| C -> T | 268, 535, 673, 829, 835, 1066, 971 |
| G -> A | 304, 444, 904, 1215, 1868 |
| T -> C | 546, 760, 803, 1214 |
| -> T | 677 |
| C-> | 736, 959 |
| A -> C | 878, 1288 |
| T-> | 1394, 1525, 1595 |
| T -> G | 1423, 1531 |

Variant protein HSI1RA_P17 (SEQ ID NO:70) according to the present invention has an amino acid sequence as given at the end of the application; it is encoded by transcript(s) HSI1RA_T19 (SEQ ID NO:64). An alignment is given to the known protein (Interleukin-1 receptor antagonist protein precursor) in the alignment table on the attached CD-ROM. A brief description of the relationship of the variant protein according to the present invention to each such aligned protein is as follows:

1. Comparison report between HSI1RA_P17 (SEQ ID NO:70) and IL1X_HUMAN (SEQ ID NO: 372):

A. An isolated chimeric polypeptide as set forth in HSI1RA_P17 (SEQ ID NO:70), comprising a first amino acid sequence being at least 90% homologous to MQAFRIWD-VNQKTFYLRNNQLVAGYLQGPNVNLE corresponding to amino acids 35-68 of IL1X_HUMAN (SEQ ID NO: 372), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said, first amino acid sequence and second amino acid sequence are contiguous and in a sequential order.

B. An isolated chimeric polypeptide encoding for an edge portion of HSI1RA_P17 (SEQ ID NO:70), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise M, having a structure as follows: a sequence starting from any of amino acid numbers 1−x to 1; and ending at any of amino acid numbers 1+((n−2)−x), in which x varies from 0 to n−2.

C. An isolated polypeptide encoding for an edge portion of HSI1RA_P17 (SEQ ID NO:70), comprising an amino acid sequence being at least 70%, optionally at least about 80%, preferably at least about 85%, more preferably at least about 90% and most preferably at least about 95% homologous to the sequence DRCGTH (SEQ ID NO: 478) of HSI1RA_P17 (SEQ ID NO:70).

2. Comparison report between HSI1RA_P17 (SEQ ID NO:70) and P18510-4 (SEQ ID NO:375):

A. An isolated chimeric polypeptide as set forth in HSI1RA_P17 (SEQ ID NO:70), comprising a first amino acid sequence being at least 90% homologous to MQAFRIWD-VNQKTFYLRNNQLVAGYLQGPNVNLE corresponding to amino acids 1-34 of P18510-4 (SEQ ID NO:375), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

B. An isolated polypeptide encoding for an edge portion of HSI1RA_P17 (SEQ ID NO:70), comprising an amino acid sequence being at least 70%, optionally at least about 80%, preferably at least about 85%, more preferably at least about 90% and most preferably at least about 95% homologous to the sequence DRCGTH (SEQ ID NO: 478) of HSI1RA_P17 (SEQ ID NO:70).

3. Comparison report between HSI1RA_P17 (SEQ ID NO:70) and NP_000568 (SEQ ID NO: 532):

A. An isolated chimeric polypeptide as set forth in HSI1RA_P17 (SEQ ID NO:70), comprising a first amino acid sequence being at least 90% homologous to MQAFRIWD-VNQKTFYLRNNQLVAGYLQGPNVNLE corresponding to amino acids 17-50 of NP_000568 (SEQ ID NO: 532), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

5. Comparison report between HSI1RA_P17 (SEQ ID NO:70) and NP_776214 (SEQ ID NO: 534):

A. An isolated chimeric polypeptide as set forth in HSI1RA_P17 (SEQ ID NO:70), comprising a first amino acid sequence being at least 90% homologous to MQAFRIWD-VNQKTFYLRNNQLVAGYLQGPNVNLE corresponding to amino acids 35-68 of NP_776214 (SEQ ID NO: 534), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

6. Comparison report between HSI1RA_P17 (SEQ ID NO:70) and NP_776213 (SEQ ID NO: 533):

A. An isolated chimeric polypeptide as set forth in HSI1RA_P17 (SEQ ID NO:70), comprising a first amino acid sequence being at least 90% homologous to MQAFRIWD-VNQKTFYLRNNQLVAGYLQGPNVNLE corresponding to amino acids 38-71 of NP_776213 (SEQ ID NO: 533), which also corresponds to amino acids 1-34 of HSI1RA_P17 (SEQ ID NO:70), and a second amino acid sequence being at least 70%, optionally at least 80%, preferably at least 85%, more preferably at least 90% and most preferably at least 95% homologous to a polypeptide having the sequence DRCGTH (SEQ ID NO: 478) corresponding to amino acids 35-40 of HSI1RA_P17 (SEQ ID NO:70), wherein said first amino acid sequence and second amino acid sequence are contiguous and in a sequential order.

The location of the variant protein was determined according to results from a number of different software programs and analyses, including analyses from SignalP and other specialized programs. The variant protein is intracellularly.

Variant protein HSI1RA_P17 (SEQ ID NO:70) also has the following non-silent SNPs (Single Nucleotide Polymorphisms) as listed in Table 105, (given according to their position(s) on the amino acid sequence, with the alternative amino acid(s) listed; the presence of known SNPs in variant protein HSI1RA_P17 (SEQ ID NO:70) sequence provides support for the deduced sequence of this variant protein according to the present invention).

TABLE 105

| Amino acid mutations | |
|---|---|
| SNP position(s) on amino acid sequence | Alternative amino acid(s) |
| 20 | Q -> * |

The glycosylation sites of variant protein HSI1RA_P17 (SEQ ID NO:70), as compared to the known protein Interleukin-1 receptor antagonist protein precursor, are described in Table 106 (given according to their position(s) on the amino acid sequence in the first column; the second column indicates whether the glycosylation site is present in the variant protein; and the last column indicates whether the position is different on the variant protein).

TABLE 106

| Glycosylation site(s) | | |
|---|---|---|
| Position(s) on known amino acid sequence | Present in variant protein? | Position(s) on variant protein |
| 109 | No | |

The variant protein has the following domains, as determined by using InterPro. The domains are described in Table 107:

TABLE 107

| InterPro domain(s) | | |
|---|---|---|
| Domain description | Analysis type | Position(s) on protein |
| Interleukin-1 | BlastProDom | 1-36 |

Variant protein HSI1RA_P17 (SEQ ID NO:70) is encoded by the following transcript(s): HSI1RA_T19 (SEQ ID NO:64), for which the coding portion starts at position 478 and ends at position 597. The transcript also has the following SNPs as listed in Table 108 (given according to their position on the nucleotide sequence, with the alternative nucleic acid listed; the presence of known SNPs in variant protein HSI1RA_P17 (SEQ ID NO:70) sequence provides support for the deduced sequence of this variant protein according to the present invention).

TABLE 108

| Nucleic acid SNPs | |
|---|---|
| Polymorphism | SNP position(s) on nucleotide sequence |
| C -> G | 40, 959, 979, 1042 |
| C -> T | 268, 535, 673, 829, 835, 971, 1066 |
| G -> A | 304, 444, 904, 1215, 1868 |
| T -> C | 546, 760, 736, 803, 1214 |
| -> T | 677 |
| C -> | 736, 959 |
| A -> C | 878, 1288 |
| T -> | 1394, 1595, 1525 |
| T -> G | 1423, 1531 |

As noted above, cluster HSI1RA features 25 segment(s), which were listed in Table 83 above and for which the sequence(s) are given. These segment(s) are portions of nucleic acid sequence(s) which are described herein separately because they are of particular interest. A description of segments 15, 17, 23, 24, 30, 36, and 37 according to the present invention is now provided.

Segment cluster HSI1RA_N17 (SEQ ID NO:73) according to the present invention is supported by 10 libraries. The number of libraries was determined as previously described. This segment can be found in the following transcript(s): HSI1RA_T2 (SEQ ID NO:61). Table 109 below describes the starting and ending position of this segment on each transcript.

TABLE 109

Segment location on transcripts

| Transcript name | Segment starting position | Segment ending position |
|---|---|---|
| HSI1RA_T2 (SEQ ID NO: 61) | 228 | 398 |

Segment cluster HSI1RA_N24 (SEQ ID NO:78) according to the present invention is supported by 11 libraries. The number of libraries was determined as previously described. This segment can be found in the following transcript(s): HSI1RA_T13 (SEQ ID NO:62) and HSI1RA_T16 (SEQ ID NO:63). Table 110 below describes the starting and ending position of this segment on each transcript.

TABLE 110

Segment location on transcripts

| Transcript name | Segment starting position | Segment ending position |
|---|---|---|
| HSI1RA_T13 (SEQ ID NO: 62) | 306 | 1203 |
| HSI1RA_T16 (SEQ ID NO: 63) | 581 | 1478 |

According to an optional embodiment of the present invention, short segments related to the above cluster are also provided. These segments are up to about 120 bp in length, and so are included in a separate description.

Segment cluster HSI1RA_N15 (SEQ ID NO:72) according to the present invention is supported by 7 libraries. The number of libraries was determined as previously described. This segment can be found in the following transcript(s): HSI1RA_T2 (SEQ ID NO:61). Table 111 below describes the starting and ending position of this segment on each transcript.

TABLE 111

Segment location on transcripts

| Transcript name | Segment starting position | Segment ending position |
|---|---|---|
| HSI1RA_T2 (SEQ ID NO: 61) | 165 | 227 |

Segment cluster HSI1RA_N23 (SEQ ID NO:77) according to the present invention is supported by 104 libraries. The number of libraries was determined as previously described. This segment can be found in the following transcript(s): HSI1RA_T13 (SEQ ID NO:62), HSI1RA_T16 (SEQ ID NO:63), HSI1RA_T19 (SEQ ID NO:64) and HSI1RA_T2 (SEQ ID NO:61). Table 112 below describes the starting and ending position of this segment on each transcript.

TABLE 112

Segment location on transcripts

| Transcript name | Segment starting position | Segment ending position |
|---|---|---|
| HSI1RA_T13 (SEQ ID NO: 62) | 217 | 305 |
| HSI1RA_T16 (SEQ ID NO: 63) | 492 | 580 |
| HSI1RA_T19 (SEQ ID NO: 64) | 492 | 580 |
| HSI1RA_T2 (SEQ ID NO: 61) | 451 | 539 |

Segment cluster HSI1RA_N30 (SEQ ID NO:84) according to the present invention is supported by 110 libraries. The number of libraries was determined as previously described. This segment can be found in the following transcript(s): HSI1RA_T13 (SEQ ID NO:62), HSI1RA_T16 (SEQ ID NO:63), HSI1RA_T19 (SEQ ID NO:64) and HSI1RA_T2 (SEQ ID NO:61). Table 113 below describes the starting and ending position of this segment on each transcript.

TABLE 113

Segment location on transcripts

| Transcript name | Segment starting position | Segment ending position |
|---|---|---|
| HSI1RA_T13 (SEQ ID NO: 62) | 1691 | 1792 |
| HSI1RA_T16 (SEQ ID NO: 63) | 1966 | 2067 |
| HSI1RA_T19 (SEQ ID NO: 64) | 581 | 682 |
| HSI1RA_T2 (SEQ ID NO: 61) | 545 | 646 |

Segment cluster HSI1RA_N36 (SEQ ID NO:87) according to the present invention is supported by 108 libraries. The number of libraries was determined as previously described. This segment can be found in the following transcript(s): HSI1RA_T13 (SEQ ID NO:62), HSI1RA_T16 (SEQ ID NO:63), HSI1RA_T19 (SEQ ID NO:64) and HSI1RA_T2 (SEQ ID NO:61). Table 114 below describes the starting and ending position of this segment on each transcript.

TABLE 114

Segment location on transcripts

| Transcript name | Segment starting position | Segment ending position |
|---|---|---|
| HSI1RA_T13 (SEQ ID NO: 62) | 1803 | 1878 |
| HSI1RA_T16 (SEQ ID NO: 63) | 2078 | 2153 |
| HSI1RA_T19 (SEQ ID NO: 64) | 693 | 768 |
| HSI1RA_T2 (SEQ ID NO: 61) | 657 | 732 |

Segment cluster HSI1RA_N37 (SEQ ID NO:88) according to the present invention is supported by 105 libraries. The number of libraries was determined as previously described. This segment can be found in the following transcript(s): HSI1RA_T13 (SEQ ID NO:62), HSI1RA_T16 (SEQ ID NO:63), HSI1RA_T19 (SEQ ID NO:64) and HSI1RA_T2 (SEQ ID NO:61). Table 115 below describes the starting and ending position of this segment on each transcript.

TABLE 115

Segment location on transcripts

| Transcript name | Segment starting position | Segment ending position |
|---|---|---|
| HSI1RA_T13 (SEQ ID NO: 62) | 1879 | 1956 |
| HSI1RA_T16 (SEQ ID NO: 63) | 2154 | 2231 |
| HSI1RA_T19 (SEQ ID NO: 64) | 769 | 846 |
| HSI1RA_T2 (SEQ ID NO: 61) | 733 | 810 |

Figure 6:
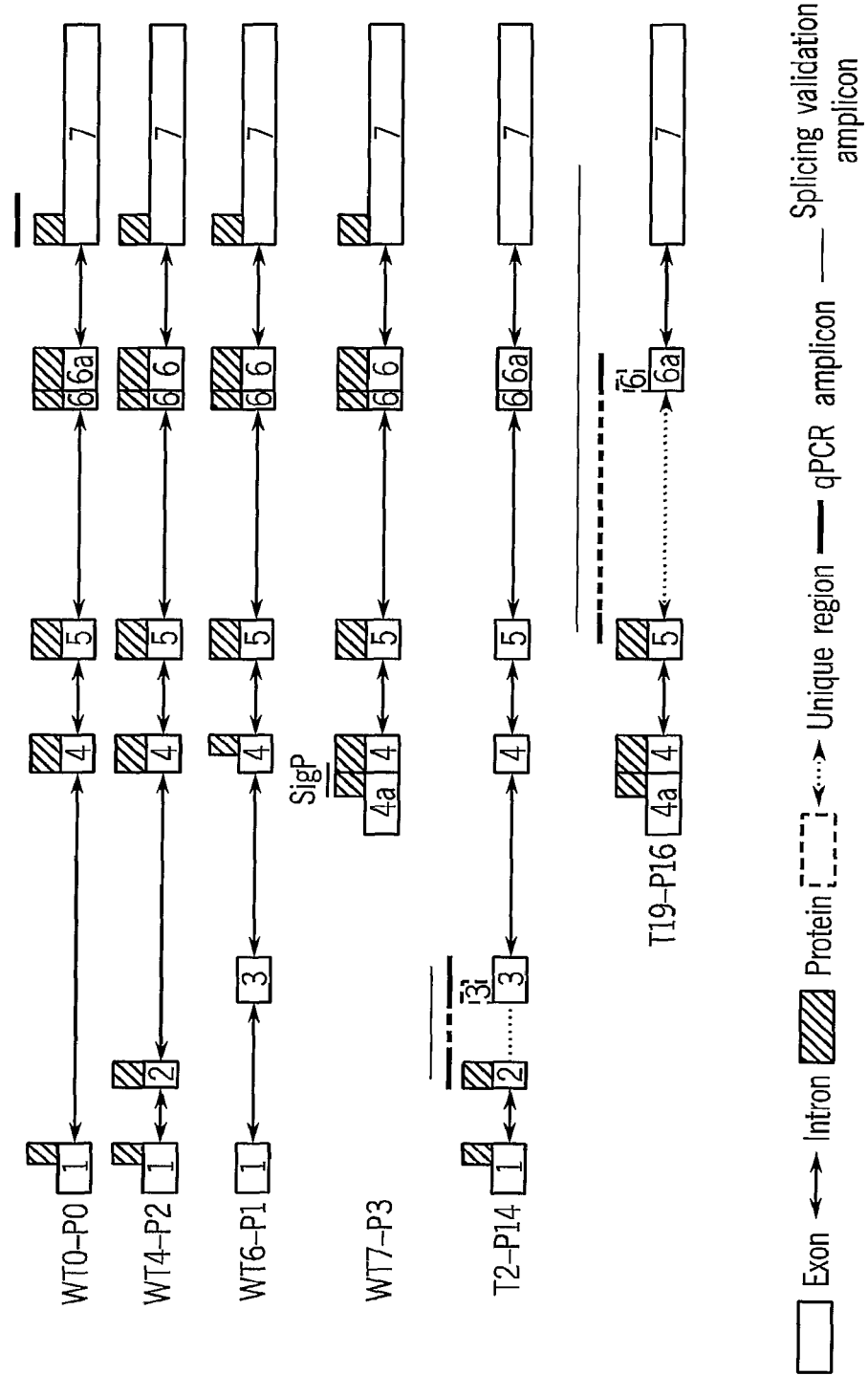
FIG. 6 shows the structure of the HSI1RA mRNA and protein variants. Exons are represented by white boxes, while introns are represented by two headed arrows. Proteins are shown in boxes with upper right to lower left fill. The unique regions are represented by white boxes with dashed frame.

FIG. 6 shows the structure of the HSI1RA mRNA and protein variants Exons are represented by white boxes, while introns are represented by two headed arrows. Proteins are shown in boxes with upper right to lower left fill. The unique regions are represented by white boxes with dashed frame. Expression of Homo sapiens interleukin 1 receptor antagonist (IL1RN) HSI1RA transcripts which are detectable by amplicon as depicted in sequence name HSI1RA_junc15-17 (SEQ ID NO:376) in normal and cancerous Lung tissues Expression of Homo sapiens interleukin 1 receptor antagonist (IL1RN) transcripts detectable by or according to junc15-17—HSI1RA_junc15-17 (SEQ ID NO:376) amplicon and primers HSI1RA_junc15-17F (SEQ ID NO:377) and HSI1RA_junc15-17R (SEQ ID NO:378) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), SDHA (GenBank Accession No. NM_004168 (SEQ ID NO:364); amplicon—SDHA-amplicon (SEQ ID NO:365)) and Ubiquitin (GenBank Accession No. BC000449 (SEQ ID NO:366); amplicon—Ubiquitin-amplicon (SEQ ID NO:367)) was measured similarly. For each RT sample, the expression of the above amplicon was normalized to the geometric mean of the quantities of the housekeeping genes. The normalized quantity of each RT sample was then divided by the median of the quantities of the normal postmortem (PM) samples (sample numbers 47, 48, 49, 50, 91, 92, 93, 96, 97 and 98, Table 3 above), to obtain a value of fold up-regulation for each sample relative to median of the normal PM samples.

Figure 7:
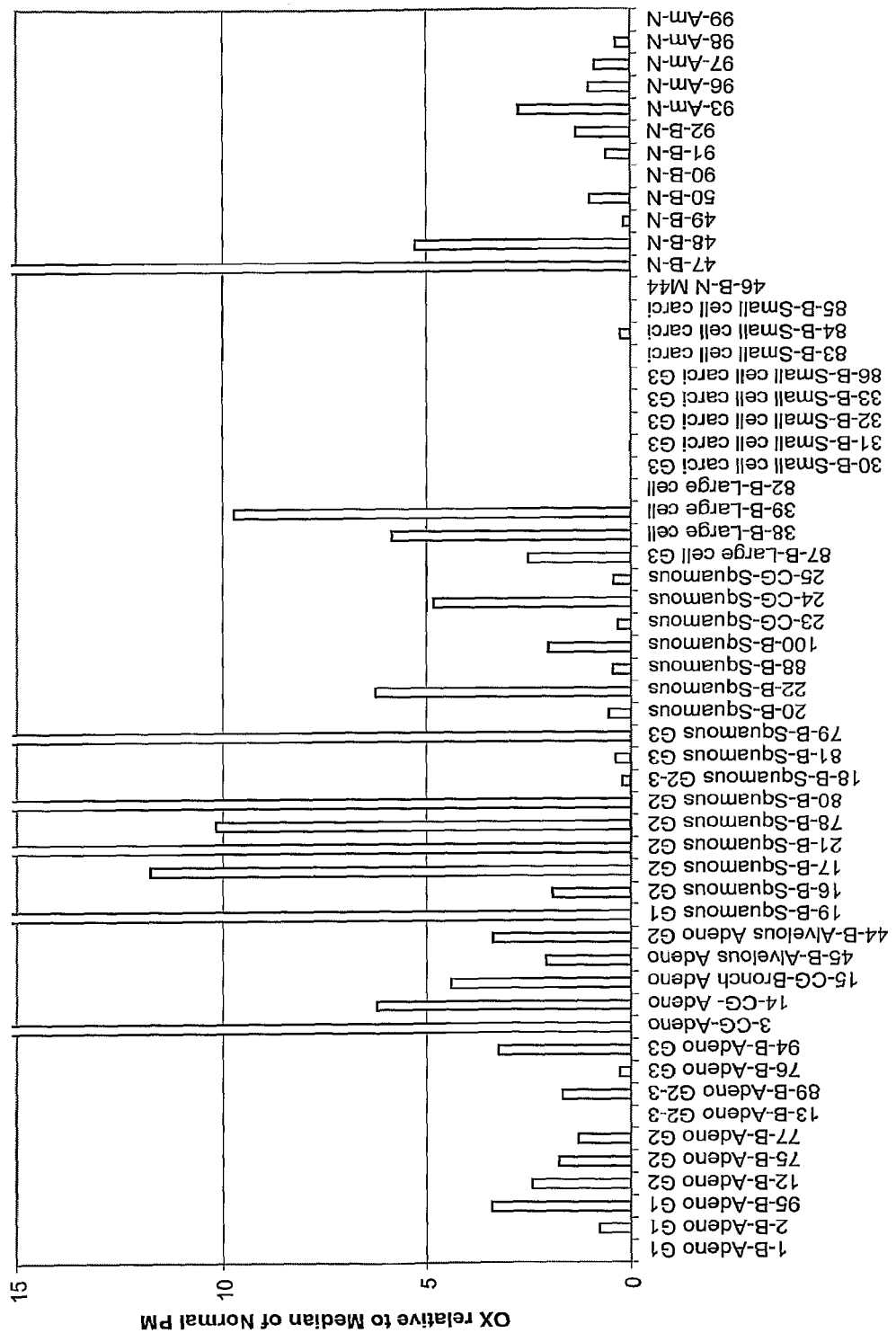
FIG. 7 is a histogram showing over expression of the *Homo sapiens* interleukin 1 receptor antagonist (IL1RN) HSI1RA transcripts which are detectable by amplicon as depicted in sequence name HSI1RA_junc15-17 (SEQ ID NO:376) in normal and cancerous Lung tissues.

FIG. 7 is a histogram showing over expression of the above-indicated Homo sapiens interleukin 1 receptor antagonist (IL1RN) transcripts in cancerous Lung samples relative to the normal samples.

As is evident from FIG. 7, the expression of Homo sapiens interleukin 1 receptor antagonist (IL1RN) transcripts detectable by the above amplicon in squamous cell carcinoma, large cell carcinoma and non-small cell carcinoma samples was higher than in the non-cancerous samples (sample numbers 47, 48, 49, 50, 91, 92, 93, 96, 97 and 98, Table 3 above). Notably an over-expression of at least 5 fold was found in 7 out of 16 squamous cell carcinoma samples, in 2 out of 3 large cell carcinoma samples and in 11 out of 32 non-small cell carcinoma samples. In addition the expression of Homo sapiens interleukin 1 receptor antagonist (IL1RN) transcripts detectable by the above amplicon in small cell carcinoma samples was lower than in the non-cancerous samples (sample numbers 47, 48, 49, 50, 91, 92, 93, 96, 97 and 98, Table 3 above).

Primer pairs are also optionally and preferably encompassed within the present invention; for example, for the above experiment, the following primer pair was used as a non-limiting illustrative example only of a suitable primer pair: HSI1RA_junc15-17F (SEQ ID NO:377) forward primer; and HSI1RA_junc15-17R (SEQ ID NO:378) reverse primer.

The present invention also preferably encompasses any amplicon obtained through the use of any suitable primer pair; for example, for the above experiment, the following amplicon was obtained as a non-limiting illustrative example only of a suitable amplicon: HSI1RA_junc15-17 (SEQ ID NO:376).

```
Forward Primer (HSI1RA_junc15-17F(SEQ ID NO: 377)):
TGCTGACTCAAAGGGGGGA

Reverse Primer (HSI1RA_junc15-17R(SEQ ID NO: 378)):
CCAGCAGTTTATGGGTTAGCTATG

Amplicon (HSI1RA_junc15-17(SEQ ID NO: 376)):
TGCTGACTCAAAGGGGGGATTATAAAACTAATCATCAAAGCCAAGAAGGC
AAGAGCAAGCATGTACCGCTGAAAACACAAGATAACTGCATAAGTAATGA
CTTTCAGTGCAGATTCATAGCTAACCCATAAACTGCTGG
```

Figure 8:
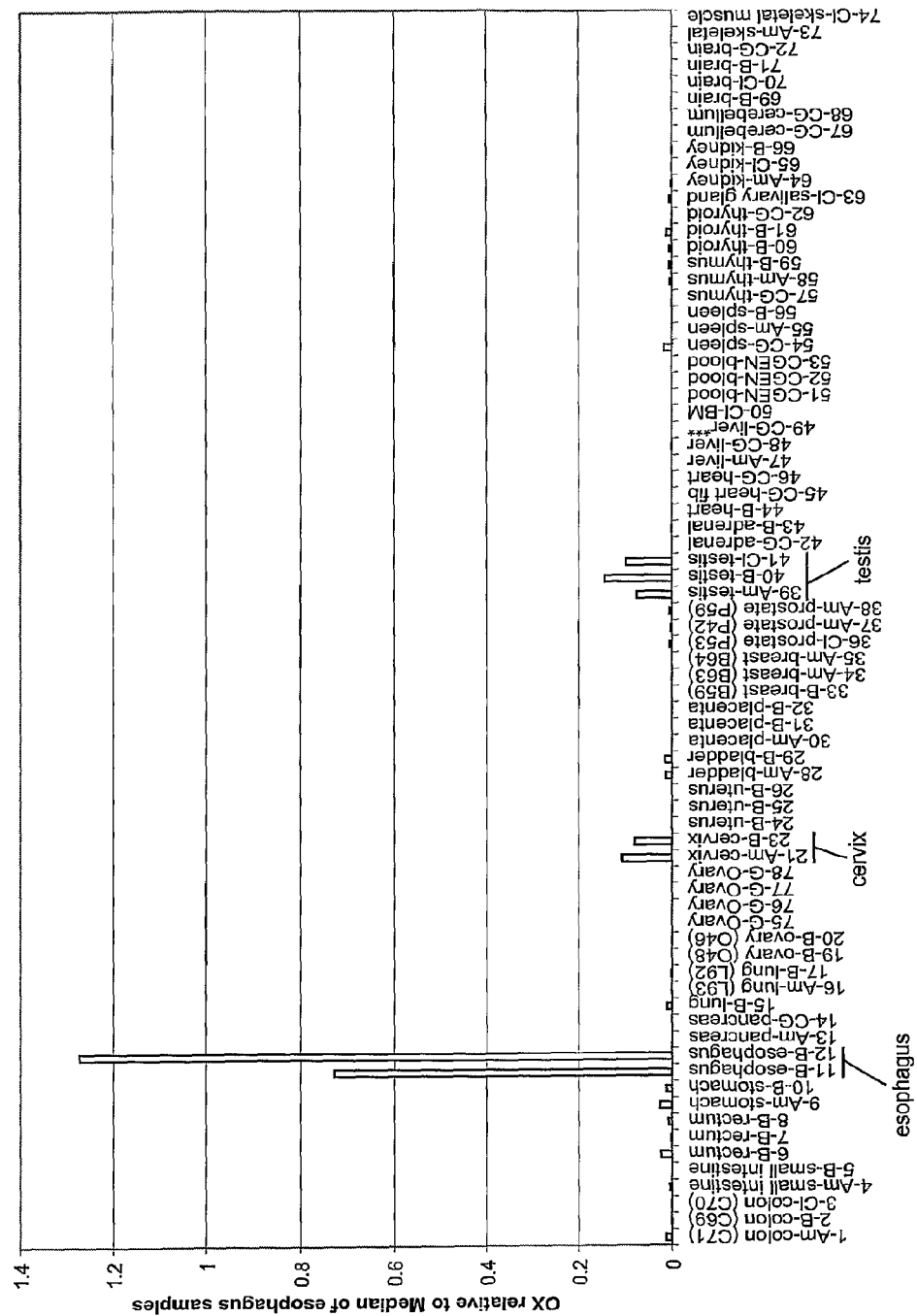
FIG. 8 shows expression of *Homo sapiens* interleukin 1 receptor antagonist (IL1RN) HSI1RA transcripts which are detectable by amplicon as depicted in sequence name HSI1RA_junc15-17 (SEQ ID NO:376) in different normal tissues.

Expression of Homo sapiens Interleukin 1 Receptor Antagonist (IL1RN) HSI1RA Transcripts which are Detectable by Amplicon as Depicted in Sequence Name HSI1RA_junc15-17 (SEQ ID NO:376) in Different Normal Tissues Expression of Homo sapiens interleukin 1 receptor antagonist (IL1RN) transcripts detectable by or according to junc15-17—HSI1RA_junc15-17 (SEQ ID NO:376) amplicon and primers HSI1RA_junc15-17F (SEQ ID NO:377) and HSI1RA_junc15-17R (SEQ ID NO:378) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the esophagus samples (sample numbers 11 and 12, Table 5 above), to obtain a value of relative expression of each sample relative to median of the eophagus samples. FIG. 8 shows expression of Homo sapiens interleukin 1 receptor antagonist (IL1RN) HSI1RA transcripts which are detectable by amplicon as depicted in sequence name HSI1RA_junc15-17 (SEQ ID NO:376) in different normal tissues.

```
Forward Primer (HSI1RA_junc15-17F(SEQ ID NO: 377)):
TGCTGACTCAAAGGGGGGA

Reverse Primer (HSI1RA_junc15-17R(SEQ ID NO: 378)):
CCAGCAGTTTATGGGTTAGCTATG

Amplicon HSI1RA_junc15-17(SEQ ID NO: 376):
TGCTGACTCAAAGGGGGGATTATAAAACTAATCATCAAAGCCAAGAAGGC
AAGAGCAAGCATGTACCGCTGAAAACACAAGATAACTGCATAAGTAATGA
CTTTCAGTGCAGATTCATAGCTAACCCATAAACTGCTGG
```

Expression of Homo sapiens Interleukin 1 Receptor Antagonist (IL1RN) HSI1RA Transcripts which are Detectable by Amplicon as Depicted in Sequence Name HSI1RA junc23-30 (SEQ ID NO: 383) in Normal and Cancerous Lung Tissues Expression of Homo sapiens interleukin 1 receptor antagonist (IL1RN) transcripts detectable by or according to junc23-

30, HSI1RA junc23-30 (SEQ ID NO: 383) amplicon and primers HSI1RA junc23-30F (SEQ ID NO: 384) and HSI1RA junc23-30R (SEQ ID NO: 385) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 3), to obtain a value of fold differential expression for each sample relative to median of the normal PM samples.

Figure 9:
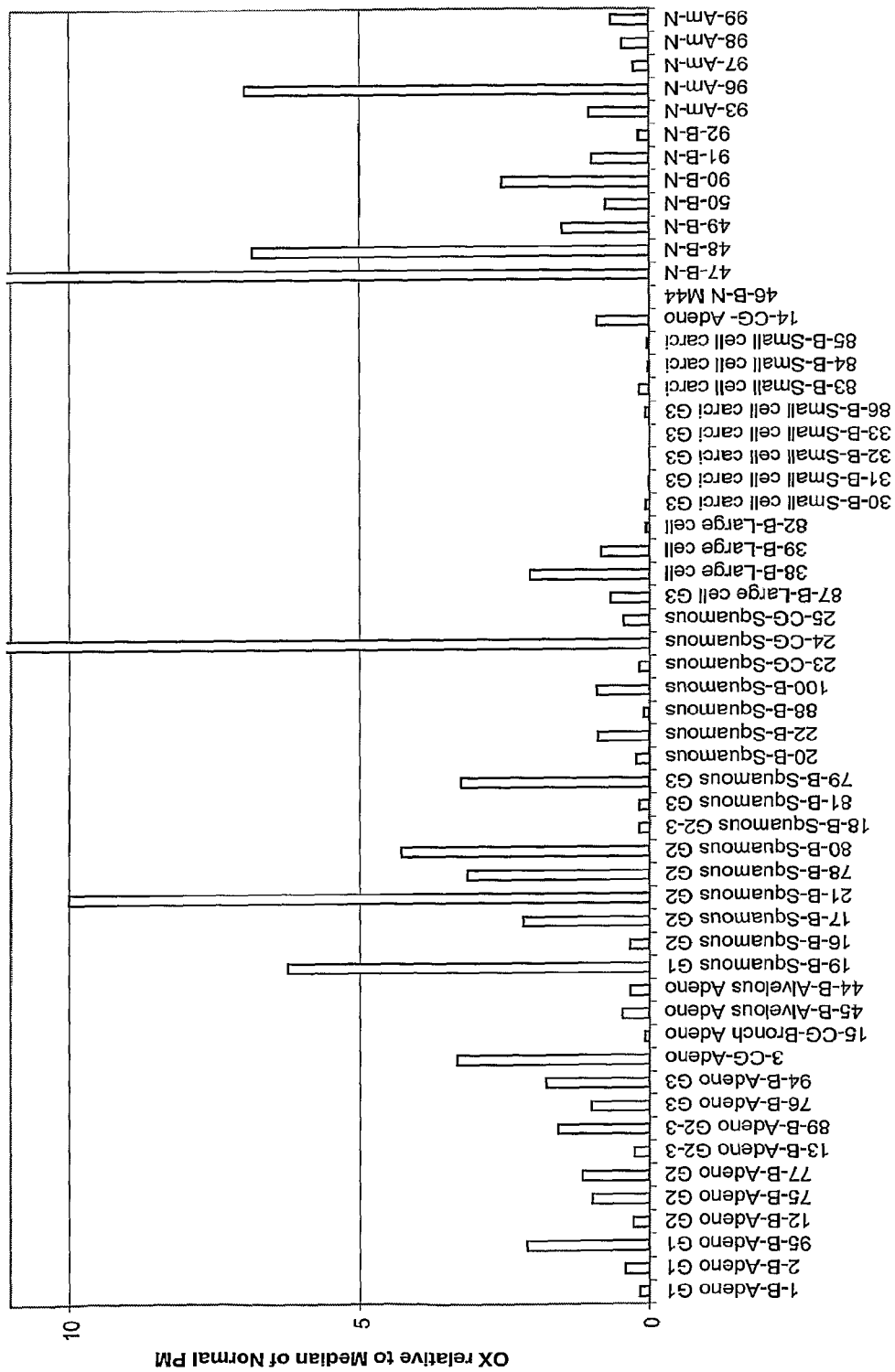
FIG. 9 is a histogram showing down regulation of the above-indicated *Homo sapiens* interleukin 1 receptor antagonist (IL1RN) transcripts in cancerous lung samples relative to the normal samples (junc23-30)

FIG. 9 is a histogram showing down regulation of the above-indicated *Homo sapiens* interleukin 1 receptor antagonist (IL1RN) transcripts in cancerous lung samples relative to the normal samples (junc23-30).

As is evident from FIG. 9, the expression of *Homo sapiens* interleukin 1 receptor antagonist (IL1RN) transcripts detectable by the above amplicon in small cell carcinoma samples was lower than in the non-cancerous samples (Sample Nos. 46-50, 90-93, 96-99 Table 3).

Primer pairs are also optionally and preferably encompassed within the present invention; for example, for the above experiment, the following primer pair was used as a non-limiting illustrative example only of a suitable primer pair: HSI1RA junc23-30F (SEQ ID NO: 384) forward primer; and HSI1RA junc23-30R (SEQ ID NO: 385) reverse primer.

The present invention also preferably encompasses any amplicon obtained through the use of any suitable primer pair; for example, for the above experiment, the following amplicon was obtained as a non-limiting illustrative example only of a suitable amplicon: HSI1RA junc23-30 (SEQ ID NO: 383).

```
Forward primer HSI1RA junc23-30F (SEQ ID NO: 384):
AGGACCAAATGTCAATTTAGAAGATAGA Reverse primer HSI1RA junc23-30R (SEQ ID NO: 385):
GACTTGACACAGGACAGGCACA Amplicon HSI1RA junc23-30 (SEQ ID NO: 383):
AGGACCAAATGTCAATTTAGAAGATAGATGTGGTACCCATTGAGCCTCAT
GCTCTGTTCTTGGGAATCCATGGAGGGAAGATGTGCCTGTCCTGTGTCAA
GTC
```

Figure 10:
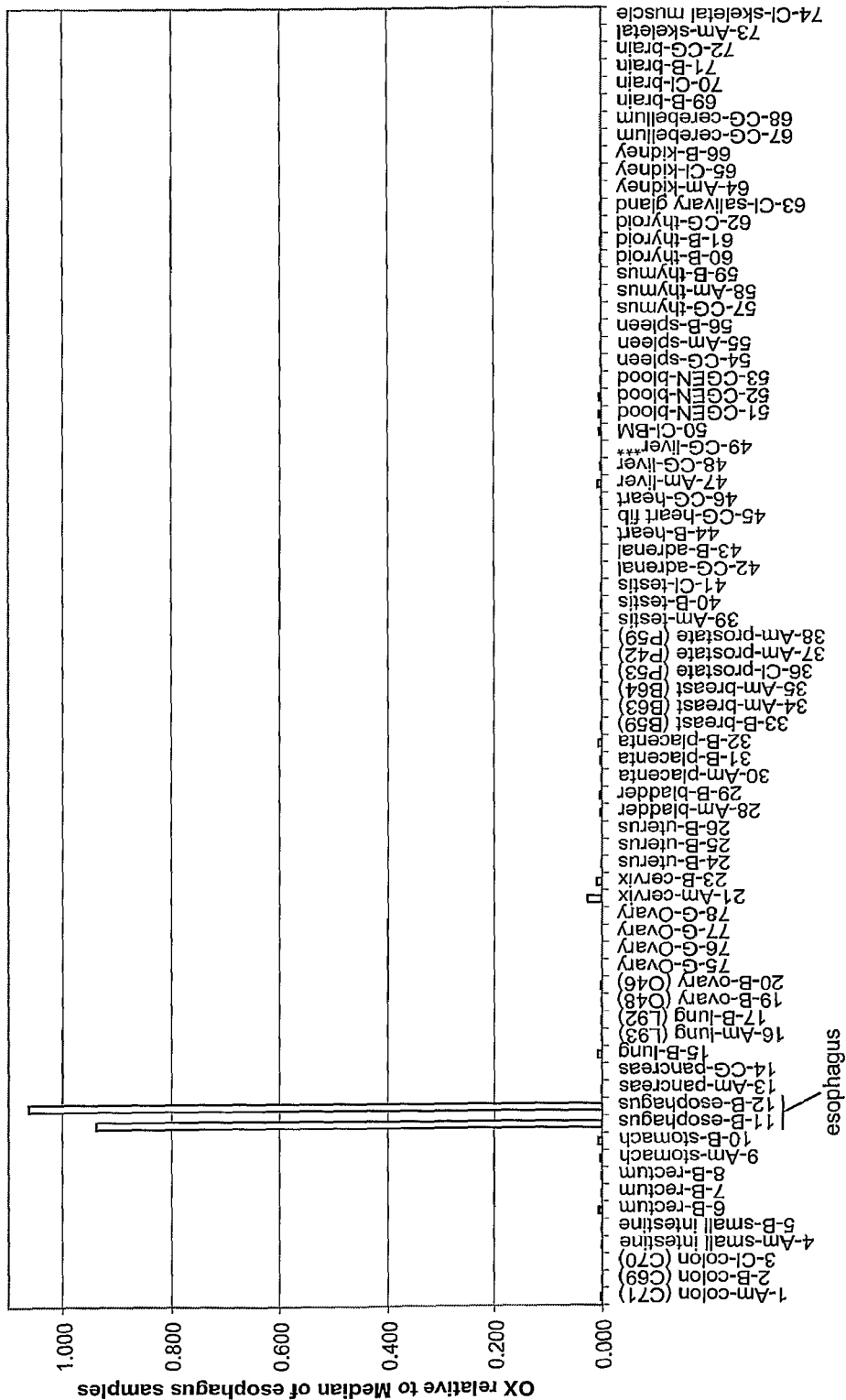
FIG. 10 shows expression of *Homo sapiens* interleukin 1 receptor antagonist (IL1RN) HSI1RA transcripts which are detectable by amplicon as depicted in sequence name HSI1RA_junc23-30 (SEQ ID NO: 383) in different normal tissues.

Expression of *Homo sapiens* Interleukin 1 Receptor Antagonist (IL1RN) HSI1RA Transcripts which are Detectable by Amplicon as Depicted in Sequence Name HSI1RA_Junc23-30 (SEQ ID NO: 383) in Different Normal Tissues Expression of *Homo sapiens* interleukin 1 receptor antagonist (IL1RN) transcripts detectable by or according to junc23-30—HSI1RA_junc23-30 (SEQ ID NO: 383) amplicon and primers HSI1RA_junc23-30F (SEQ ID NO: 384) and HSI1RA_junc23-30R (SEQ ID NO: 385) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the esophagus samples (sample numbers 11 and 12, Table 5 above), to obtain a value of relative expression of each sample relative to median of the esophagus samples. FIG. 10 shows expression of *Homo sapiens* interleukin 1 receptor antagonist (IL1RN) HSI1RA transcripts which are detectable by amplicon as depicted in sequence name HSI1RA_junc23-30 (SEQ ID NO: 383) in different normal tissues.

```
Forward Primer (HSI1RA junc23-30F (SEQ ID NO:
384)):
AGGACCAAATGTCAATTTAGAAGATAGA Reverse Primer (HSI1RA junc23-30R (SEQ ID NO:
385)):
GACTTGACACAGGACAGGCACA Amplicon HSHRA junc23-30 (SEQ ID NO: 383):
AGGACCAAATGTCAATTTAGAAGATAGATGTGGTACCCATTGAGCCTCAT
GCTCTGTTCTTGGGAATCCATGGAGGGAAGATGTGCCTGTCCTGTGTCAA
GTC
```

Expression of *Homo sapiens* Interleukin 1 Receptor Antagonist (IL1RN) HSI1RA Transcripts which are Detectable by Amplicon as Depicted in Sequence Name HSI1RA seg23-24 (SEQ ID NO: 386) in Normal and Cancerous Lung Tissues Expression of *Homo sapiens* interleukin 1 receptor antagonist (IL1RN) transcripts detectable by or according to seg23-24, HSI1RA seg23-24 (SEQ ID NO: 386) amplicon and primers HSI1RA seg23-24F (SEQ ID NO: 387) and HSI1RA seg23-24R (SEQ ID NO: 388) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples, for which the values are presented in FIG. 10A (Sample Nos. 47-50, 90-93, 96-99, Table 3, above). Then the reciprocal of this ratio was calculated, to obtain a value of fold down-regulation for each sample relative to median of the normal PM samples for which values are presented in FIG. 11B.

Figure 11A:
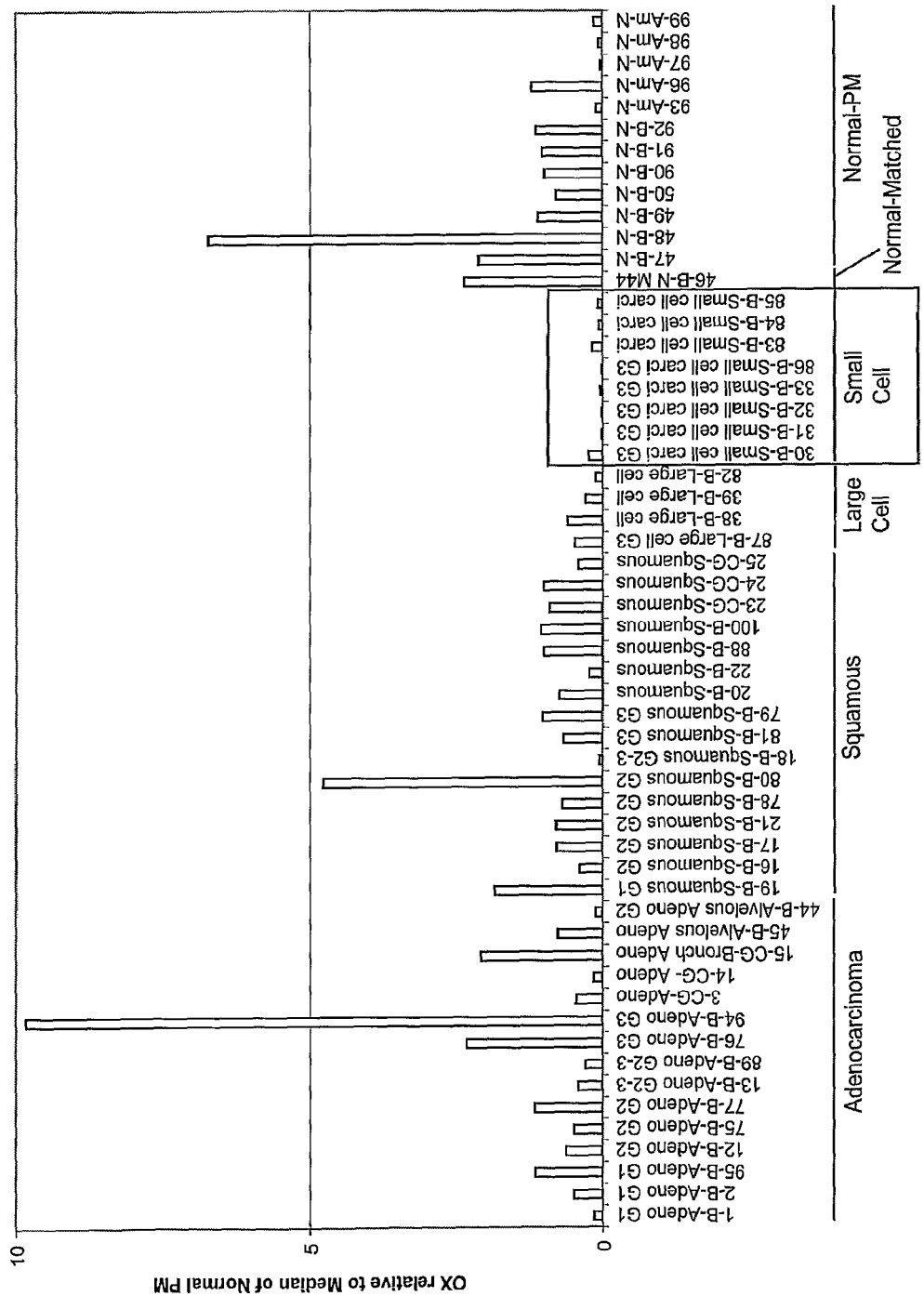
FIGS. 11A and 11B are histograms showing down regulation of the above-indicated *Homo sapiens* interleukin 1 receptor antagonist (IL1RN) transcripts in cancerous lung samples relative to the normal samples (seg 23-24)
Figure 11B:
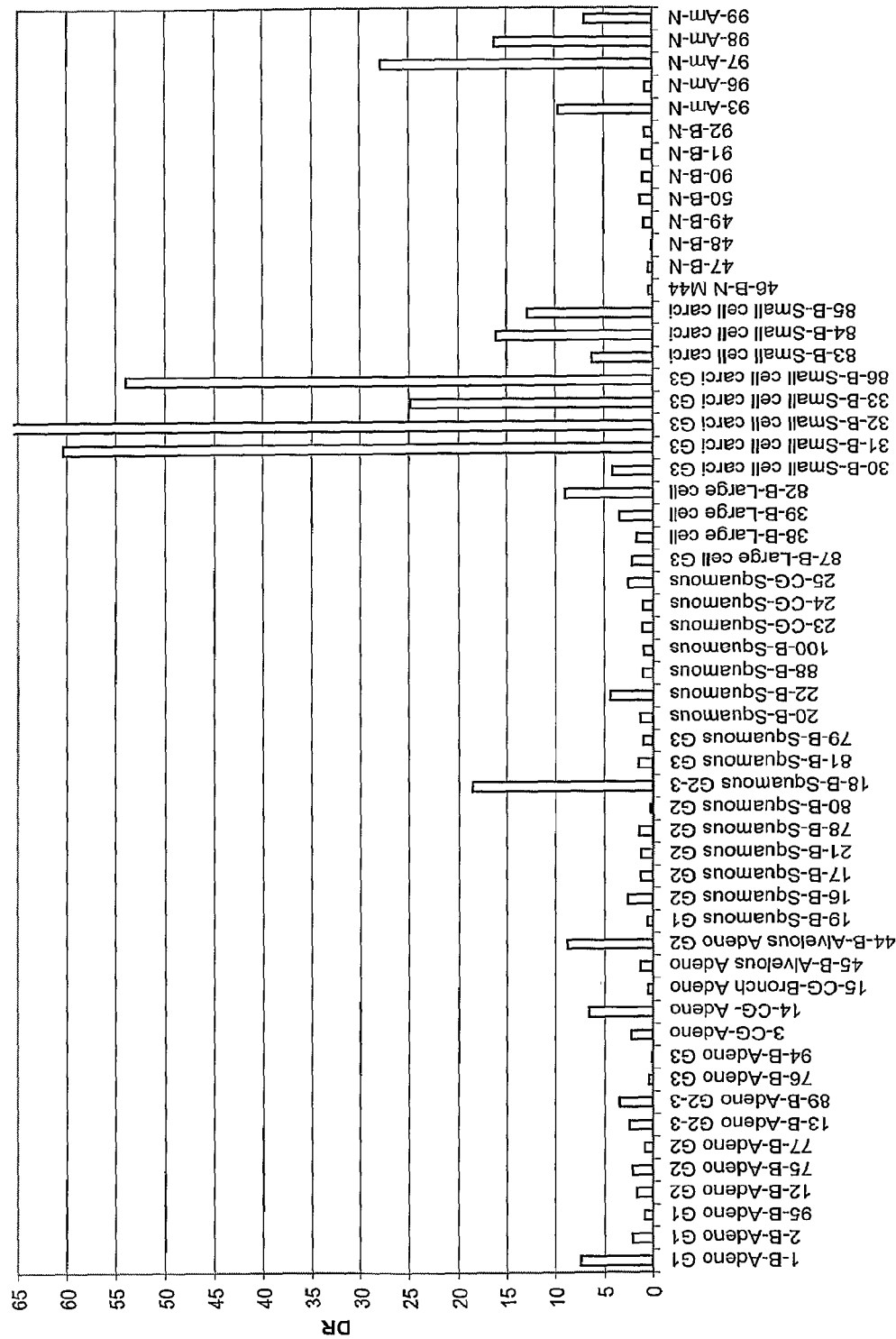

FIGS. 11A and 11B are histograms showing down regulation of the above-indicated *Homo sapiens* interleukin 1 receptor antagonist (IL1RN) transcripts in cancerous lung samples relative to the normal samples (seg 23-24).

As is evident from FIGS. 11A and 11B, the expression of *Homo sapiens* interleukin 1 receptor antagonist (IL1RN) transcripts detectable by the above amplicon in small cell carcinoma samples was significantly lower than in the noncancerous samples (Sample Nos. 46-50, 90-93, 96-99 Table 3). Notably down regulation of at least 5 fold was found in 7 out of 8 small cells carcinoma samples.

Statistical analysis was applied to verify the significance of these results, as described below.

The P value for the difference in the expression levels of *Homo sapiens* interleukin 1 receptor antagonist (IL1RN) transcripts detectable by the above amplicon in lung cancer samples versus the normal tissue samples was determined by T test as 5.02E-02.

Threshold of 5 fold down regulation was found to differentiate between cancer and normal samples with P value of 2.49E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSI1RA seg23-24F (SEQ ID NO: 387) forward primer; and HSI1RA seg23-24R (SEQ ID NO: 388) reverse primer.

The present invention also preferably encompasses any amplicon obtained through the use of any suitable primer pair; for example, for the above experiment, the following amplicon was obtained as a non-limiting illustrative example only of a suitable amplicon: HSI1RA seg23-24 (SEQ ID NO: 386).

```
Forward primer HSI1RA seg23-24F (SEQ ID NO: 387):
CAACCAACTAGTTGCTGGATACTTG

Reverse primer HSI1RA seg23-24R (SEQ ID NO: 388):
GGCAAAGTGACGTGATGCC

Amplicon HSI1RA seg23-24 (SEQ ID NO: 386):
CAACCAACTAGTTGCTGGATACTTGCAAGGACCAAATGTCAATTTAGAAG
GTGAGTGGTTGCCAGGAAAGCCAATGTATGTGGGCATCACGTCACTTTGC
C
```

Figure 12:
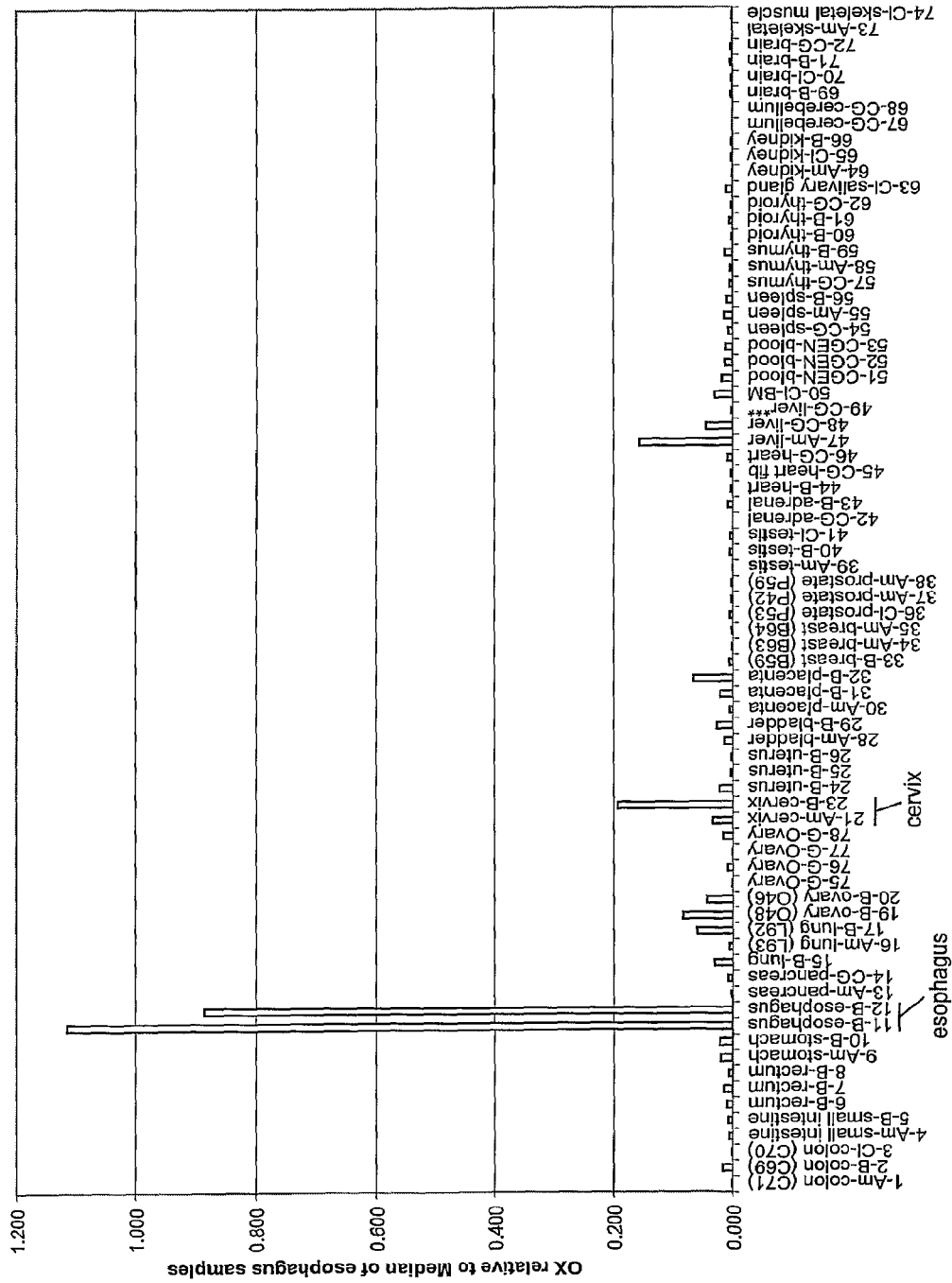
FIG. 12 shows expression of *Homo sapiens* interleukin 1 receptor antagonist (IL1RN) HSI1RA transcripts which are detectable by amplicon as depicted in sequence name HSI1RA_seg23-24 (SEQ ID NO: 386) in different normal tissues.

Expression of *Homo sapiens* Interleukin 1 Receptor Antagonist (IL1RN) HSI1RA Transcripts which are Detectable by Amplicon as Depicted in Sequence Name HSI1RA_seg23-24 (SEQ ID NO: 386) in Different Normal Tissues Expression of *Homo sapiens* interleukin 1 receptor antagonist (IL1RN) transcripts detectable by or according to seg23-24—HSI1RA_seg23-24 (SEQ ID NO: 386) amplicon and primers HSI1RA_seg23-24F (SEQ ID NO: 387) and HSI1RA_seg23-24R (SEQ ID NO: 388) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the esophagus samples (sample numbers 11 and 12, Table 5 above), to obtain a value of relative expression of each sample relative to median of the esophagus samples. FIG. 12 shows expression of *Homo sapiens* interleukin 1 receptor antagonist (IL1RN) HSI1RA transcripts which are detectable by amplicon as depicted in sequence name HSI1RA_seg23-24 (SEQ ID NO: 386) in different normal tissues.

```
Forward Primer (HSI1RA_seg23-24F (SEQ ID NO: 387)):
CAACCAACTAGTTGCTGGATACTTG Reverse Primer (HSI1RA_seg23-24R (SEQ ID NO: 388)):
GGCAAAGTGACGTGATGCC Amplicon HSI1RA_seg23-24 (SEQ ID NO: 386):
CAACCAACTAGTTGCTGGATACTTGCAAGGACCAAATGTCAATTTAGAAG
GTGAGTGGTTGCCAGGAAAGCCAATGTATGTGGGCATCACGTCACTTTGC
C
```

Expression of *Homo sapiens* Interleukin 1 Receptor Antagonist (IL1RN) HSI1RA Transcripts which are Detectable by Amplicon as Depicted in Sequence Name HSI1RA seg36-37WT (SEQ ID NO: 389) in Normal and Cancerous Lung Tissues Expression of *Homo sapiens* interleukin 1 receptor antagonist (IL1RN) transcripts detectable by or according to seg36-37, HSI1RA seg36-37WT (SEQ ID NO: 389) amplicon and primers HSI1RA seg36-37WTF (SEQ ID NO: 390) and HSI1RA seg36-37WTR (SEQ ID NO: 391) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples for which values presented in FIG. 13A (Sample Nos. 47-50, 90-93, 96-99, Table 3, above). Then the reciprocal of this ratio was calculated, to obtain a value of fold down-regulation for each sample relative to median of the normal PM samples for which values are presented in FIG. 13B.

Figure 13A:
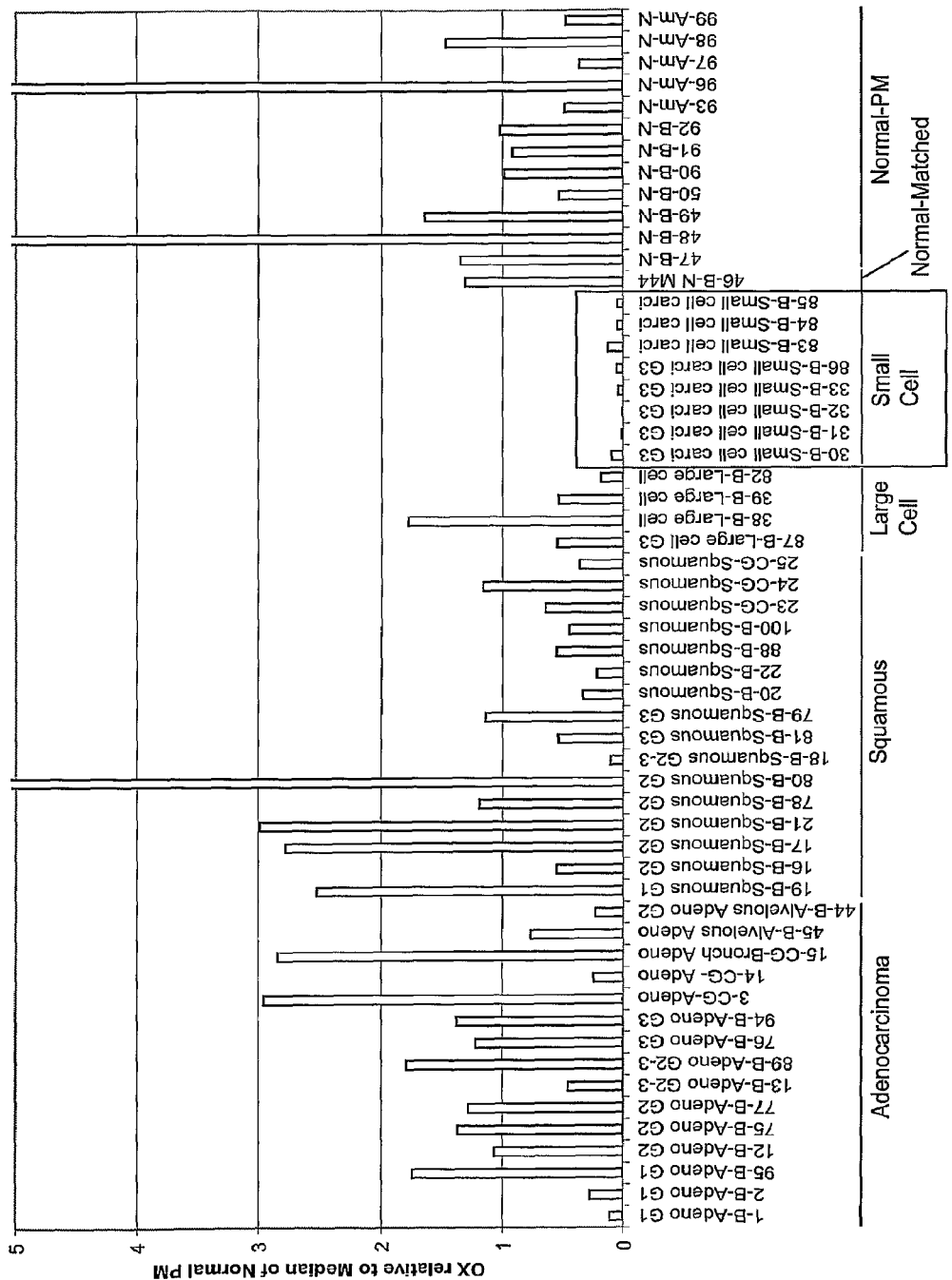
FIGS. 13A and 13B are histograms showing down regulation of the above-indicated *Homo sapiens* interleukin 1 receptor antagonist (IL1RN) transcripts in cancerous lung samples relative to the normal samples (seg 36-37)
Figure 13B:
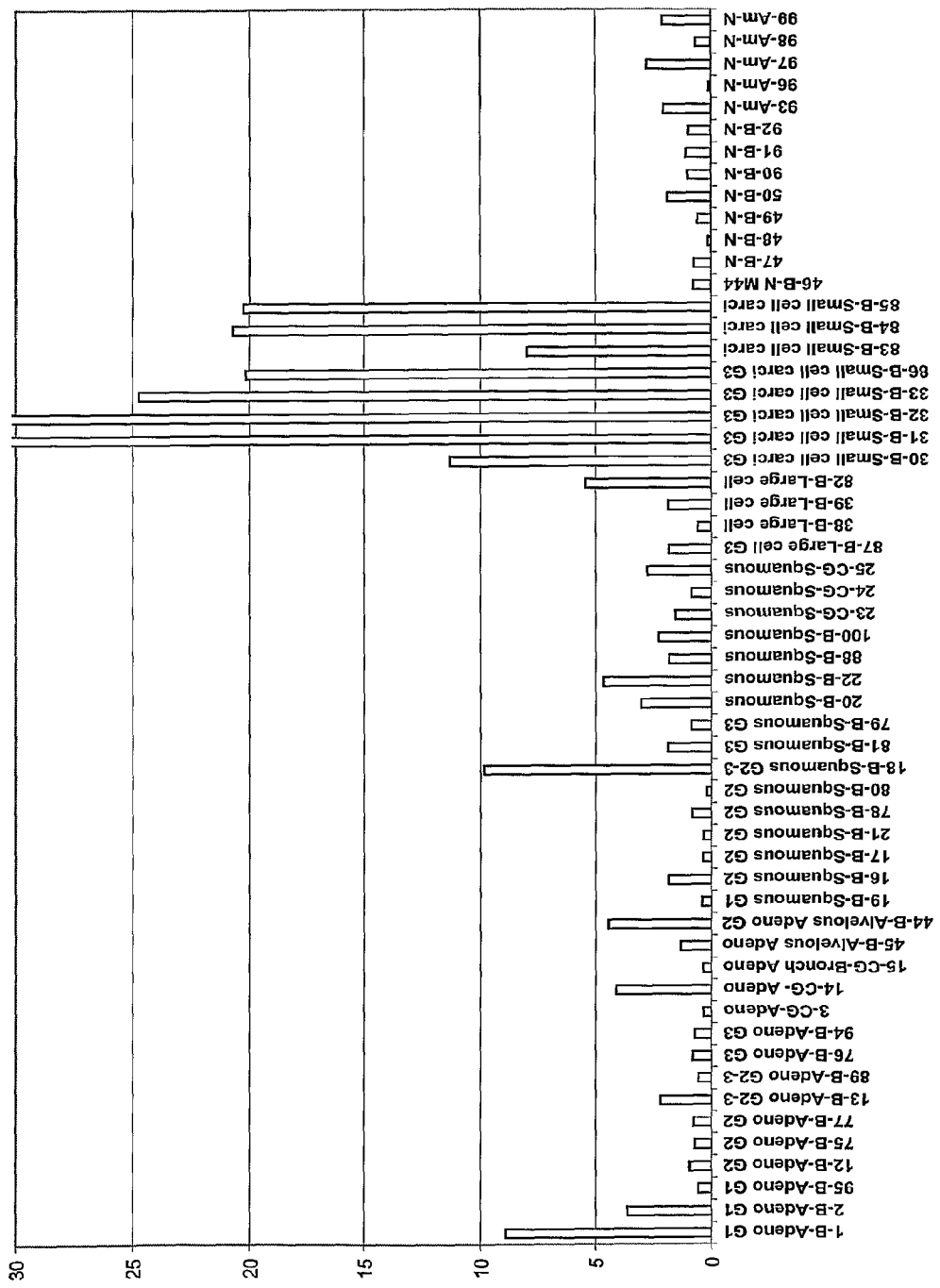

FIGS. 13A and 13B are histograms showing down regulation of the above-indicated *Homo sapiens* interleukin 1 receptor antagonist (IL1RN) transcripts in cancerous lung samples relative to the normal samples (seg 36-37).

As is evident from FIGS. 12A and 12B, the expression of *Homo sapiens* interleukin 1 receptor antagonist (IL1RN) transcripts detectable by the above amplicon in small cell carcinoma samples was significantly lower than in the non-cancerous samples (Sample Nos. 46-50, 90-93, 96-99 Table 3). Notably down regulation of at least 5 fold was found in 8 out of 8 small cells carcinoma samples.

Statistical analysis was applied to verify the significance of these results, as described below.

Threshold of 5 fold down regulation was found to differentiate between small cell carcinoma and normal samples with P value of 7.94E-06 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSI1RA seg36-37WTF (SEQ ID NO: 390) forward primer; and HSI1RA seg36-37WTR (SEQ ID NO: 391) reverse primer.

The present invention also preferably encompasses any amplicon obtained through the use of any suitable primer pair; for example, for the above experiment, the following amplicon was obtained as a non-limiting illustrative example only of a suitable amplicon: HSI1RA seg36-37WT (SEQ ID NO: 389).

```
Forward primer HSI1RA seg36-37WTF (SEQ ID NO: 390):
GAGCGAGAACAGAAAGCAGGA

Reverse primer HSI1RA seg36-37WTR (SEQ ID NO: 391):
GCTGTGCAGAGGAACCAACC

Amplicon HSI1RA seg36-37WT (SEQ ID NO: 389):
GAGCGAGAACAGAAAGCAGGACAAGCGCTTCGCCTTCATCCGCTCAGACA
GTGGCCCCACCACCAGTTTTGAGTCTGCCGCCTGCCCCGGTTGGTTCCTC
TGCACAGC
```

Figure 14:
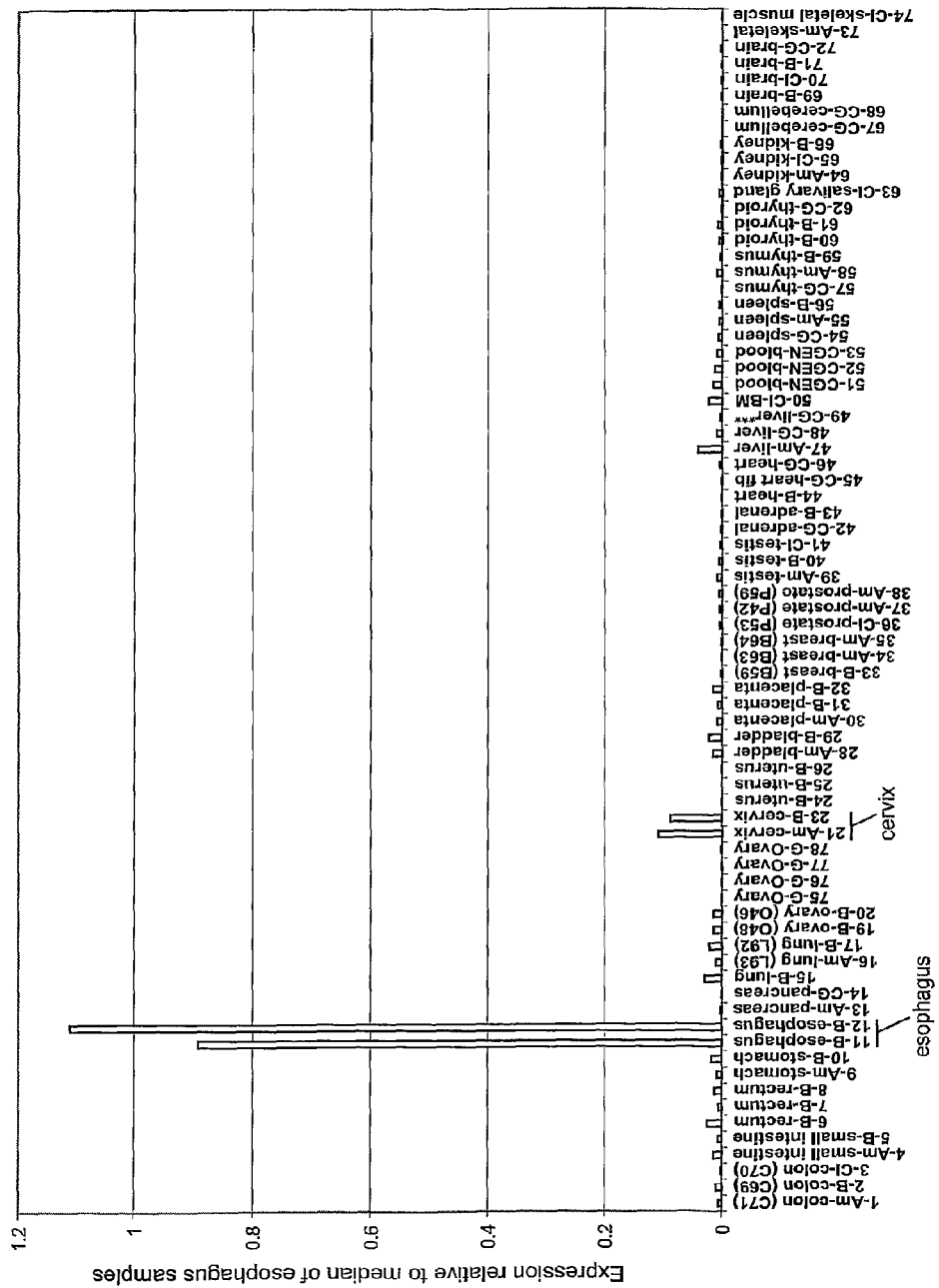
FIG. 14 shows expression of *Homo sapiens* interleukin 1 receptor antagonist (IL1RN) HSI1RA transcripts which are detectable by amplicon as depicted in sequence name HSI1RA_seg36-37WT (SEQ ID NO: 389) in different normal tissues.

Expression of *Homo sapiens* Interleukin 1 Receptor Antagonist (IL1RN) HSI1RA Transcripts which are Detectable by Amplicon as Depicted in Sequence Name HSI1RA_seg36-37WT (SEQ ID NO: 389) in Different Normal Tissues Expression of *Homo sapiens* interleukin 1 receptor antagonist (IL1RN) transcripts detectable by or according to seg36-37WT—HSI1RA_seg36-37WT (SEQ ID NO: 389) amplicon and primers HSI1RA_seg36-37WTF (SEQ ID NO: 390) and HSI1RA_seg36-37WTR (SEQ ID NO: 391) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the esophagus samples (sample numbers 11 and 12, Table 5 above), to obtain a value of relative expression of each sample relative to median of the esophagus samples. FIG. 14 shows expression of *Homo sapiens* interleukin 1 receptor antagonist (IL1RN) HSI1RA transcripts which are detectable by amplicon as depicted in sequence name HSI1RA_seg36-37WT (SEQ ID NO: 389) in different normal tissues.

```
Forward Primer (HSI1RA_seg36-37WTF (SEQ ID NO:
390)):
GAGCGAGAACAGAAAGCAGGA

Reverse Primer (HSI1RA_seg36-37WTR (SEQ ID NO:
391)):
GCTGTGCAGAGGAACCAACC

Amplicon HSI1RA_seg36-37WT (SEQ ID NO: 389):
GAGCGAGAACAGAAAGCAGGACAAGCGCTTCGCCTTCATCCGCTCAGACA
GTGGCCCCACCACCAGTTTTGAGTCTGCCGCCTGCCCCGGTTGGTTCCTC
TGCACAGC
```

Description for Cluster HSPLGF

Cluster HSPLGF features 3 transcript(s) and 11 segment(s) of interest, the names for which are given in Tables 116 and 117, respectively. The selected protein variants are given in table 118.

TABLE 116

Transcripts of interest

| Transcript Name |
| --- |
| HSPLGF_1_T2 (SEQ ID NO: 96) |
| HSPLGF_1_T6 (SEQ ID NO: 97) |
| HSPLGF_1_T15 (SEQ ID NO: 98) |

TABLE 117

Segments of interest

| Segment Name |
| --- |
| HSPLGF_1_N0 (SEQ ID NO: 103) |
| HSPLGF_1_N2 (SEQ ID NO: 104) |
| HSPLGF_1_N7 (SEQ ID NO: 107) |
| HSPLGF_1_N21 (SEQ ID NO: 113) |
| HSPLGF_1_N3 (SEQ ID NO: 105) |
| HSPLGF_1_N4 (SEQ ID NO: 106) |
| HSPLGF_1_N9 (SEQ ID NO: 108) |
| HSPLGF_1_N14 (SEQ ID NO: 109) |
| HSPLGF_1_N15 (SEQ ID NO: 110) |
| HSPLGF_1_N16 (SEQ ID NO: 111) |
| HSPLGF_1_N17 (SEQ ID NO: 112) |

TABLE 118

Proteins of interest

| Protein Name | Corresponding Transcript(s) |
| --- | --- |
| HSPLGF_1_P4 (SEQ ID NO: 99) | HSPLGF_1_T2 (SEQ ID NO: 96) |
| HSPLGF_1_P5 (SEQ ID NO: 100) | HSPLGF_1_T6 (SEQ ID NO: 97) |
| HSPLGF_1_P13 (SEQ ID NO: 101) | HSPLGF_1_T15 (SEQ ID NO: 98) |
| HSPLGF_1_P14 (SEQ ID NO: 102) | HSPLGF_1_T6 (SEQ ID NO: 97) |

These sequences are variants of the known protein Placenta growth factor precursor (SwissProt accession identifier PLGF_HUMAN (SEQ ID NO:392); known also according to the synonyms PlGF), referred to herein as the previously known protein.

Protein Placenta growth factor precursor is known or believed to have the following function(s): Growth factor active in angiogenesis, and endothelial cell growth, stimulating their proliferation and migration. It binds to receptor VEGFR-1/FLT1. PLGF-2 binds neuropilin-1 and 2 in a heparin-dependent manner. Known polymorphisms for this sequence are as shown in Table 119.

TABLE 119

Amino acid mutations for Known Protein

| SNP position(s) on amino acid sequence | Comment |
|---|---|
| 91 | N -> D |

Protein Placenta growth factor precursor localization is believed to be secreted but PlGF-2 form appears to remain cell attached unless released by heparin.

The following GO Annotation(s) apply to the previously known protein. The following annotation(s) were found: cell-cell signaling; positive regulation of cell proliferation; signal transduction, which are annotation(s) related to Biological Process; and growth factor activity, which are annotation(s) related to Molecular Function.

The GO assignment relies on information from one or more of the SwissProt/TremBl Protein knowledgebase or Locuslink.

According to optional embodiments of the present invention, variants of this cluster according to the present invention (amino acid and/or nucleic acid sequences of HSPLGF) may optionally have one or more of the following utilities, as described with regard to the Table below. It should be noted that these utilities are optionally and preferably suitable for human and non-human animals as subjects, except where otherwise noted. The reasoning is described with regard to biological and/or physiological and/or other information about the known protein, but is given to demonstrate particular diagnostic utility for the variants according to the present invention.

HSPLGF placental growth factor, a member of the vascular endothelial growth factor (VEGF) family, is a molecular marker for inflammation. Upregulation of placental growth factor has been found in several conditions associated with pathological angiogenesis and monocyte recruitment that underlie chronic inflammatory disease. In patients with acute chest pain, a high blood level of placental growth factor predicts a poor prognosis.

TABLE 120

Utilities for Variants of HSPLGF, related to placental growth factor:

| Dx field | Explanation | Ref |
|---|---|---|
| Inflammation | Chronic transgenic delivery of PlGF-2 to murine epidermis resulted in a significantly increased inflammatory response, associated with more pronounced vascular enlargement, edema, and inflammatory cell infiltration than seen in wild-type mice. Conversely, PlGF deficiency resulted in a diminished and abbreviated inflammatory response, together with a reduction of inflammatory angiogenesis and edema formation. | Blood First Edition Paper on Sep. 5, 2002; DOI 10.1182/blood-2002-05-1516 |
| Marker for Crohn's disease and ulcerative colitis patients in remission versus active disease | Protein microarray analysis of disease activity in pediatric inflammatory bowel disease demonstrates elevated serum PLGF levels in Crohn's disease and ulcerative colitis patients in remission versus active disease | Am J Gastroenterol. 2005 February; 100(2): 414-23 |
| Prognostic Value of in Patients With Acute Chest Pain (predicting ACS) | In patients with ACS, elevated PlGF levels indicated a markedly increased risk for death or nonfatal myocardial infarction | JAMA. 2004; 291: 435-441 |
| Biomarker for detection of ischemia and risk stratification in acute coronary syndrome | after 30 days. It acts as a primary inflammatory instigator of atherosclerotic plaque instability and thus may be useful as a risk-predicting biomarker in patients with acute coronary syndromes (ACS). | Clin Chem. 2005 May; 51(5): 810-24. Epub 2005 Mar. 17. |
| Prediction of preeclampsia in the early second trimester of pregnancy | A decreased maternal serum placenta growth factor concentration in the early second trimester is highly associated with the subsequent development of preeclampsia | Obstetrics & Gynecology 2001; 97: 898-904 Int J Gynaecol Obstet. 2005 June; 89(3): 251-7. Epub 2005 Apr. 2. |
| Predicts Cardiovascular Morbidity and Mortality in Type 1 Diabetic Patients with Diabetic Nephropathy. | Elevated Placental Growth Factor (PlGF) Predicts Cardiovascular Morbidity and Mortality in Type 1 Diabetic Patients with Diabetic Nephropathy. | Scand J Clin Lab Invest Suppl. 2005; 240: 73-9. |
| Marker for survival of patients with colorectal cancer | The majority of PlGF was expressed in tumour cells. The ratio of PlGF expression in tumour to non-tumour in the advanced disease group was significantly higher than for the | Gut. 2005 May; 54(5): 666-72. |

TABLE 120-continued

Utilities for Variants of HSPLGF, related to placental growth factor:

| Dx field | Explanation | Ref |
| --- | --- | --- |
| | localised disease group (p = 0.009). Patients with more tumour PlGF mRNA had shorter survival (p = 0.028). | |
| Marker for gastric cancer diagnosis, staging and grading | PlGF expression level was significantly correlated with serosal invasion, positive lymph node metastases, tumor stages, and patient survival. | Cancer Lett. 2004 Sep. 15; 213(1): 73-82. |
| Marker for grading and tumor vasculrity assessment as prognostic factors in renal cell cancer (RCC), - as a stand alone marker or in combination with VEGF | PlGF and VEGF levels in patients with RCC were significantly higher than those in non-cancer controls. PlGF levels were significantly associated with histological grade and total tumor vascularity (TTV), and VEGF levels were significantly associated with T, M stage, histological grade, venous invasion and TTV. Multivariate analysis showed plasma PlGF was an independent prognostic factor. These findings suggested that plasma PlGF levels were significantly associated with the clinical features of RCC, especially prognostic significance. | Anticancer Res. 2003 November-December; 23(6D): 4953-8. |

According to other optional embodiments of the present invention, variants of this cluster according to the present invention (amino acid and/or nucleic acid sequences of HSPLGF) may optionally have one or more of the following utilities, some of which are related to utilities described above. It should be noted that these utilities are optionally and preferably suitable for human and non-human animals as subjects, except where otherwise noted.

According to other optional embodiments of the present invention, variants of this cluster according to the present invention (amino acid and/or nucleic acid sequences of HSPLGF) may optionally have one or more of the following utilities: used as surrogate markers, that should be measured in subjects undergoing various treatments of diseases such as Chronic inflammation and ACS.

Treatments for chronic inflammation using, for example, COX1 and COX2 inhibitors, Steroids, TNF blockers (like Humira); and treatments for ACS thrombolysis (e.g. tPA, streptokinase), aspirin, or catheterization may affect the level of variants of HSPLGF cluster according to the present invention (amino acid and/or nucleic acid sequences of HSPLGF) and therefore it may serve as surrogate marker.

Other non-limiting exemplary utilities for HSPLGF variants according to the present invention are described in greater detail below and also with regard to the previous section on clinical utility.

As noted above, cluster HSPLGF features 3 transcript(s), which were listed in Table 116 above. These transcript(s) encode for protein(s) which are variant(s) of protein Placenta growth factor precursor. A description of each variant protein according to the present invention is now provided.

Variant protein HSPLGF_1_P4 (SEQ ID NO:99) according to the present invention has an amino acid sequence as given at the end of the application; it is encoded by transcript(s) HSPLGF_1_T2 (SEQ ID NO:96). An alignment is given to the known protein (Placenta growth factor precursor) at the end of the application. in the alignment table on the attached CD-ROM. A brief description of the relationship of the variant protein according to the present invention to each such aligned protein is as follows:

1. Comparison report between HSPLGF_1_P4 (SEQ ID NO:99) and P49763-2 (SEQ ID NO: 536):

A. An isolated chimeric polypeptide as set forth in HSPLGF_1_P4 (SEQ ID NO:99), comprising a first amino acid sequence being at least 90% homologous to MPVMRLFPCFLQLLAGLALPAVPPQQWALSAG-NGSSEVEVVPFQEVWGRSYCRALERLVD-VVSEYPSEVEHM FSPSCVSLLRCTGCCGDENLHCVPVET-ANVTMQLLKIRSGDRPSYVELTFSQH-VRCECRPLREKMKPE corresponding to amino acids 1-140 of P49763-2 (SEQ ID NO: 536), which also corresponds to amino acids 1-140 of HSPLGF_1_P4 (SEQ ID NO:99), and a second amino acid sequence being at least 70%, optionally at least 80%, preferably at least 85%, more preferably at least 90% and most preferably at least 95% homologous to a polypeptide having the sequence SHLVLTLGLLQEETQGQGEEEEREAETHRLP-PVRRCCSPEVTHPLEERDPAPGSCIYYRHTLQ (SEQ ID NO: 480) corresponding to amino acids 141-203 of HSPLGF_1_P4 (SEQ ID NO:99), wherein said first amino acid sequence and second amino acid sequence are contiguous and in a sequential order.

B. An isolated polypeptide encoding for an edge portion of HSPLGF_1_P4 (SEQ ID NO:99), comprising an amino acid sequence being at least 70%, optionally at least about 80%, preferably at least about 85%, more preferably at least about 90% and most preferably at least about 95% homologous to the sequence SHLVLTLGLLQEETQGQGEEEEREA-ETHRLPPVRRCCSPEVTHPLEERDPAPG-SCIYYRHTLQ (SEQ ID NO: 480) of HSPLGF_1_P4 (SEQ ID NO:99).

The location of the variant protein was determined according to results from a number of different software programs and analyses, including analyses from SignalP and other specialized programs. The variant protein is secreted.

The variant protein has the following domains, as determined by using InterPro. The domains are described in Table 121:

TABLE 121

| Domain description | Analysis type | Position(s) on protein |
| --- | --- | --- |
| InterPro domain(s) | | |
| Platelet-derived growth factor (PDGF) | BlastProDom | 43-129 |
| Platelet-derived growth factor (PDGF) | HMMPfam | 52-130 |
| Platelet-derived growth factor (PDGF) | HMMSmart | 50-132 |
| Platelet-derived growth factor (PDGF) | Profile Scan | 39-135 |
| Platelet-derived growth factor (PDGF) | ScanRegExp | 75-87 |

Variant protein HSPLGF_1_P4 (SEQ ID NO:99) is encoded by the following transcript(s): HSPLGF_1_T2 (SEQ ID NO:96), for which the coding portion starts at position 523 and ends at position 1131. The transcript also has the following SNPs as listed in Table 122 (given according to their position on the nucleotide sequence, with the alternative nucleic acid listed; the presence of known SNPs in variant protein HSPLGF_1_P4 (SEQ ID NO:99) sequence provides support for the deduced sequence of this variant protein according to the present invention).

TABLE 122

| Polymorphism | SNP position(s) on nucleotide sequence |
| --- | --- |
| Nucleic acid SNPs | |
| G -> T | 132 |
| T -> C | 166 |
| G -> A | 293, 387, 1192 |
| G -> | 456 |
| A -> T | 1253 |
| A -> G | 1305, 1686 |
| C -> | 1422 |
| C -> T | 1422 |
| T -> A | 1432 |
| A -> | 1464, 1466 |
| C -> G | 1684 |
| C -> A | 1708 |

Variant protein HSPLGF_1_P5 (SEQ ID NO:100) according to the present invention has an amino acid sequence as given at the end of the application; it is encoded by transcript(s) HSPLGF_1_T6 (SEQ ID NO:97)

The location of the variant protein was determined according to results from a number of different software programs and analyses, including analyses from SignalP and other specialized programs. The variant protein is intracellular.

Variant protein HSPLGF_1_P5 (SEQ ID NO:100) is encoded by the following transcript(s): HSPLGF_1_T6 (SEQ ID NO:97), for which the coding portion starts at position 2 and ends at position 331. The transcript also has the following SNPs as listed in Table 123 (given according to their position on the nucleotide sequence, with the alternative nucleic acid listed; the presence of known SNPs in variant protein HSPLGF_1_P5 (SEQ ID NO:100) sequence provides support for the deduced sequence of this variant protein according to the present invention).

TABLE 123

| Polymorphism | SNP position(s) on nucleotide sequence |
| --- | --- |
| Nucleic acid SNPs | |
| G -> A | 1464 |
| A -> T | 1525 |
| A -> G | 1577, 1958 |
| C -> | 1694 |
| C -> T | 1694 |
| T -> A | 1704 |
| A -> | 1736, 1738 |
| C -> G | 1956 |
| C -> A | 1980 |

Variant protein HSPLGF_1_P13 (SEQ ID NO:101) according to the present invention has an amino acid sequence as given at the end of the application; it is encoded by transcript(s) HSPLGF_1_T15 (SEQ ID NO:98). An alignment is given to the known protein (Placenta growth factor precursor) in the alignment table on the attached CD-ROM. A brief description of the relationship of the variant protein according to the present invention to each such aligned protein is as follows:

1. Comparison report between HSPLGF_1_P13 (SEQ ID NO:101) and P49763-2 (SEQ ID NO: 536):

A. An isolated chimeric polypeptide as set forth in HSPLGF_1_P13 (SEQ ID NO:101), comprising a amino acid sequence being at least 90% homologous to MPVMRLFPCFLQLLAGLALPAVPPQQWALSAG-NGSSEVEVVPFQEVWGRSYCRALERLVD-VVSEYPSEVEHM FSPSCVSLLRCTGCCGDENLHCVPVET-ANVTMQLLKIRSGDRPSYVELTFSQH-VRCECRPLREKMKPER corresponding to amino acids 1-141 of P49763-2 (SEQ ID NO: 536), which also corresponds to amino acids 1-141 of HSPLGF_1_P13 (SEQ ID NO:101).

3.

The location of the variant protein was determined according to results from a number of different software programs and analyses, including analyses from SignalP and other specialized programs. The variant protein is secreted.

The variant protein has the following domains, as determined by using InterPro. The domains are described in Table 124:

TABLE 124

| Domain description | Analysis type | Position(s) on protein |
| --- | --- | --- |
| InterPro domain(s) | | |
| Platelet-derived growth factor (PDGF) | BlastProDom | 43-129 |
| Platelet-derived growth factor (PDGF) | HMMPfam | 52-130 |
| Platelet-derived growth factor (PDGF) | HMMSmart | 50-132 |
| Platelet-derived growth factor (PDGF) | ProfileScan | 39-135 |
| Platelet-derived growth factor (PDGF) | ScanRegExp | 75-87 |

Variant protein HSPLGF_1_P13 (SEQ ID NO:101) is encoded by the following transcript(s): HSPLGF_1_T15 (SEQ ID NO:98), for coding portion starts at position 523 and ends at position 945. The transcript also has the following SNPs as listed in Table 125 (given according to their position on the nucleotide sequence, with the alternative nucleic acid listed; the presence of known SNPs in variant protein HSPLGF_1_P13 (SEQ ID NO:101) sequence provides support for the deduced sequence of this variant protein according to the present invention).

TABLE 125

Nucleic acid SNPs

| Polymorphism | SNP position(s) on nucleotide sequence |
|---|---|
| G -> T | 132 |
| T -> C | 166 |
| G -> A | 293, 387, 1264 |
| G -> | 456 |
| A -> T | 1325 |
| A -> G | 1377, 1758 |
| C -> | 1494 |
| C -> T | 1494 |
| T -> A | 1504 |
| A -> | 1536, 1538 |
| C -> G | 1756 |
| C -> A | 1780 |

Variant protein HSPLGF_1_P14 (SEQ ID NO:102) according to the present invention has an amino acid sequence as given at the end of the application; it is encoded by transcript(s) HSPLGF_1_T6 (SEQ ID NO:97).

The location of the variant protein was determined according to results from a number of different software programs and analyses, including analyses from SignalP and other specialized programs. The variant protein is membrane.

Variant protein HSPLGF_1_P14 (SEQ ID NO:102) is encoded by the following transcript(s): HSPLGF_1_T6 (SEQ ID NO:97), for which the coding portion starts at position 846 and ends at position 1154. The transcript also has the following SNPs as listed in Table 126 (given according to their position on the nucleotide sequence, with the alternative nucleic acid listed; the presence of known SNPs in variant protein HSPLGF_1_P14 (SEQ ID NO:102) sequence provides support for the deduced sequence of this variant protein according to the present invention).

TABLE 126

Nucleic acid SNPs

| Polymorphism | SNP position(s) on nucleotide sequence |
|---|---|
| G -> A | 1464 |
| A -> T | 1525 |
| A -> G | 1577, 1958 |
| C -> | 1694 |
| C -> T | 1694 |
| T -> A | 1704 |
| A -> | 1736, 1738 |
| C -> G | 1956 |
| C -> A | 1980 |

As noted above, cluster HSPLGF features 11 segment(s), which were listed in Table 117 above and for which the sequence(s) are given. These segment(s) are portions of nucleic acid sequence(s) which are described herein separately because they are of particular interest. A description of segments 7, 15, 16, and 21 according to the present invention is now provided.

Segment cluster HSPLGF_1 N7 (SEQ ID NO:107) according to the present invention is supported by 74 libraries. The number of libraries was determined as previously described. This segment can be found in the following transcript(s): HSPLGF_1_T15 (SEQ ID NO:98), HSPLGF_1_T2 (SEQ ID NO:96) and HSPLGF_1_T6 (SEQ ID NO:97). Table 127 below describes the starting and ending position of this segment on each transcript.

TABLE 127

Segment location on transcripts

| Transcript name | Segment starting position | Segment ending position |
|---|---|---|
| HSPLGF_1_T15 (SEQ ID NO: 98) | 641 | 837 |
| HSPLGF_1_T2 (SEQ ID NO: 96) | 641 | 837 |
| HSPLGF_1_T6 (SEQ ID NO: 97) | 1007 | 1203 |

Segment cluster HSPLGF_1 N21 (SEQ ID NO:113) according to the present invention is supported by 154 libraries. The number of libraries was determined as previously described. This segment can be found in the following transcript(s): HSPLGF_1_T15 (SEQ ID NO:98), HSPLGF_1_T2 (SEQ ID NO:96) and HSPLGF_1_T6 (SEQ ID NO:97). Table 128 below describes the starting and ending position of this segment on each transcript.

TABLE 128

Segment location on transcripts

| Transcript name | Segment starting position | Segment ending position |
|---|---|---|
| HSPLGF_1_T15 (SEQ ID NO: 98) | 1111 | 2015 |
| HSPLGF_1_T2 (SEQ ID NO: 96) | 1039 | 1943 |
| HSPLGF_1_T6 (SEQ ID NO: 97) | 1311 | 2215 |

According to an optional embodiment of the present invention, short segments related to the above cluster are also provided. These segments are up to about 120 bp in length, and so are included in a separate description.

Segment cluster HSPLGF_1 N15 (SEQ ID NO:110) according to the present invention is supported by 1 libraries. The number of libraries was determined as previously described. This segment can be found in the following transcript(s): HSPLGF_1_T15 (SEQ ID NO:98). Table 129 below describes the starting and ending position of this segment on each transcript.

TABLE 129

Segment location on transcripts

| Transcript name | Segment starting position | Segment ending position |
|---|---|---|
| HSPLGF_1_T15 (SEQ ID NO: 98) | 945 | 1016 |

Segment cluster HSPLGF_1 N16 (SEQ ID NO:111) according to the present invention is supported by 2 libraries. The number of libraries was determined as previously described. This segment can be found in the following transcript(s): HSPLGF_1_T15 (SEQ ID NO:98) and HSPLGF_1_T2 (SEQ ID NO:96). Table 130 below describes the starting and ending position of this segment on each transcript.

TABLE 130

Segment location on transcripts

| Transcript name | Segment starting position | Segment ending position |
|---|---|---|
| HSPLGF_1_T15 (SEQ ID NO: 98) | 1017 | 1047 |
| HSPLGF_1_T2 (SEQ ID NO: 96) | 945 | 975 |

Figure 15:
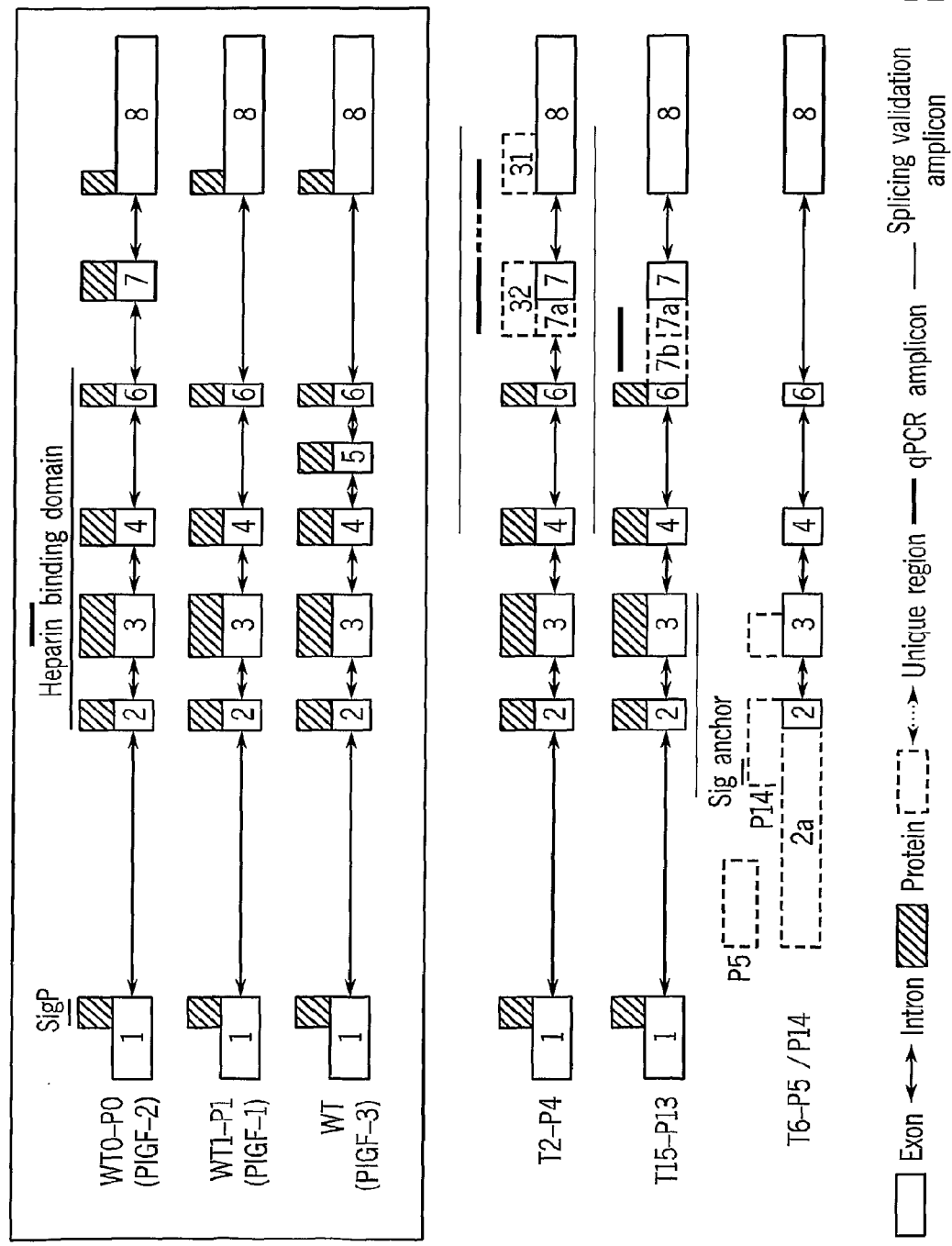
FIG. 15 shows the structure of the HSPLGF mRNA and protein variants. Exons are represented by white boxes, while introns are represented by two headed arrows. Proteins are shown in boxes with upper right to lower left fill. The unique regions are represented by white boxes with dashed frame.

FIG. 15 shows the structure of the HSPLGF mRNA and protein variants. Exons are represented by white boxes, while introns are represented by two headed arrows. Proteins are shown in boxes with upper right to lower left fill. The unique regions are represented by white boxes with dashed frame.

Expression of *Homo sapiens* Placental Growth Factor, Vascular Endothelial Growth Factor-Related Protein (PlGF) HSPLGF Transcripts which are Detectable by Amplicon as Depicted in Sequence Name HSPLGF_seg7_WT (SEQ ID NO:393) in Normal and Cancerous Lung Tissues Expression of *Homo sapiens* placental growth factor, vascular endothelial growth factor-related protein (PlGF) transcripts detectable by or according to seg7_WT—HSPLGF_seg7_WT (SEQ ID NO:393) amplicon and primers HSPLGF_seg7F_WT (SEQ ID NO:394) and HSPLGF_seg7R_WT (SEQ ID NO:395) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), SDHA (GenBank Accession No. NM_004168 (SEQ ID NO:364); amplicon—SDHA-amplicon (SEQ ID NO:365)) and Ubiquitin (GenBank Accession No. BC000449 (SEQ ID NO:366); amplicon—Ubiquitin-amplicon (SEQ ID NO:367)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold up-regulation for each sample relative to median of the normal PM samples.

Figure 16:
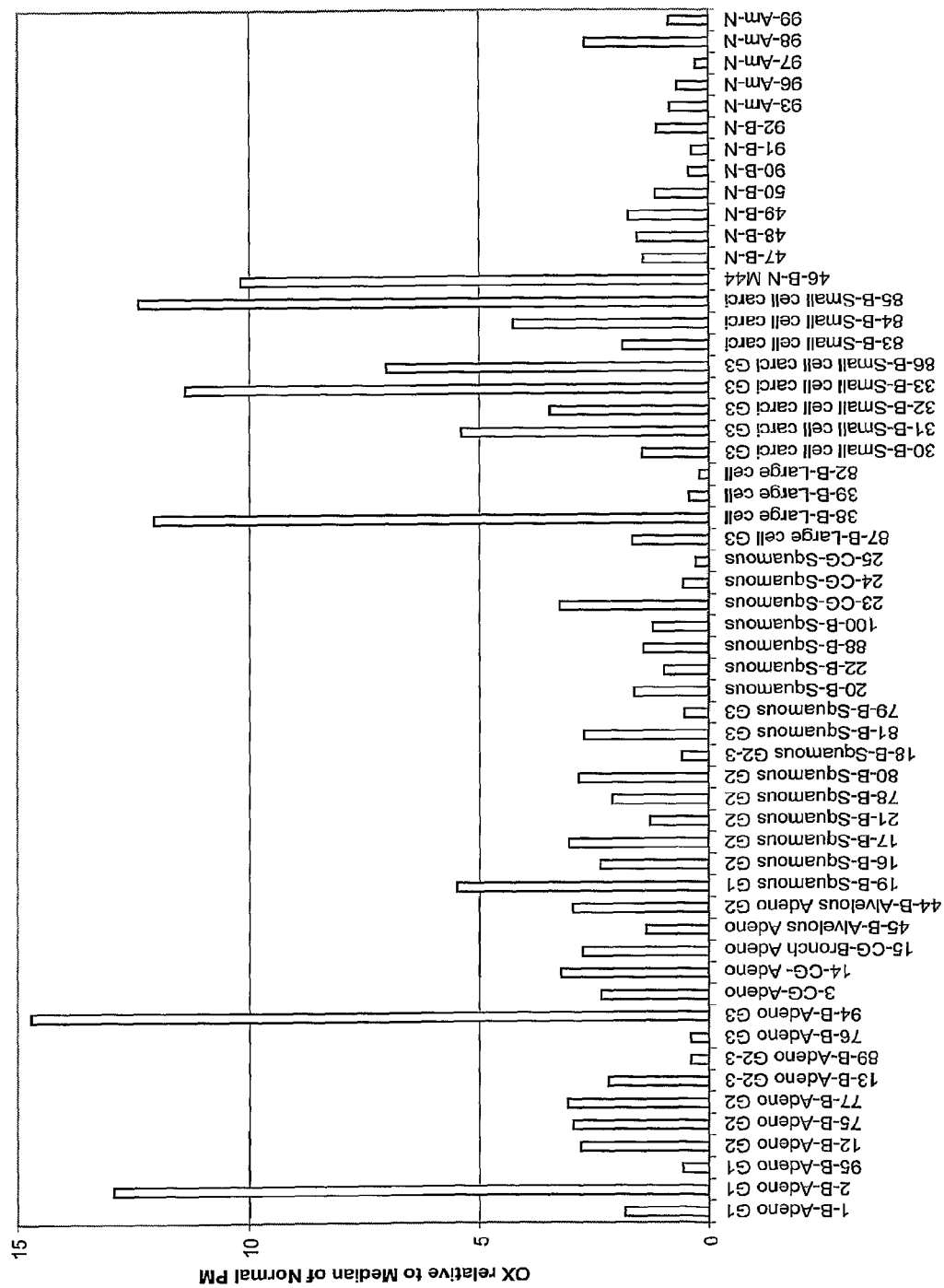
FIG. 16 is a histogram showing over expression of the above-indicated *Homo sapiens* placental growth factor, vascular endothelial growth factor-related protein (PLGF) transcripts in cancerous Lung samples relative to the normal samples.

FIG. 16 is a histogram showing over expression of the above-indicated *Homo sapiens* placental growth factor, vascular endothelial growth factor-related protein (PLGF) transcripts in cancerous Lung samples relative to the normal samples.

As is evident from FIG. 16, the expression of *Homo sapiens* placental growth factor, vascular endothelial growth factor-related protein (PlGF) transcripts detectable by the above amplicon in small cell carcinoma samples was significantly higher than in the non-cancerous samples (sample numbers 47, 48, 49, 50, 90, 91, 92, 93, 96, 97, 98 and 99, Table 3 above) and was higher in a few non-small cell carcinoma samples than in the non-cancerous samples. Notably an over-expression of at least 5 fold was found in 4 out of 8 small cell carcinoma samples and in 4 out of 35 non-small cell carcinoma samples.

Statistical analysis was applied to verify the significance of these results, as described below.

The P value for the difference in the expression levels of *Homo sapiens* placental growth factor, vascular endothelial growth factor-related protein (PlGF) transcripts detectable by the above amplicon in Lung adenocarcinoma samples versus the normal tissue samples was determined by T test as 3.85e-002. The P value for the difference in the expression levels of *Homo sapiens* placental growth factor, vascular endothelial growth factor-related protein (PlGF) transcripts detectable by the above amplicon in Lung small cell carcinoma samples versus the normal tissue samples was determined by T test as 1.30e-002. The P value for the difference in the expression levels of *Homo sapiens* placental growth factor, vascular endothelial growth factor-related protein (PlGF) transcripts detectable by the above amplicon in Lung non-small cell carcinoma samples versus the normal tissue samples was determined by T test as 7.42e-003.

Threshold of 5 fold over expression was found to differentiate between small cell carcinoma and normal samples with P value of 1.44e-002 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: HSPLGF_seg7F_WT (SEQ ID NO:394) forward primer; and HSPLGF_seg7R_WT (SEQ ID NO:395) reverse primer.

The present invention also preferably encompasses any amplicon obtained through the use of any suitable primer pair; for example, for the above experiment, the following amplicon was obtained as a non-limiting illustrative example only of a suitable amplicon: HSPLGF_seg7_WT (SEQ ID NO:393).

```
Forward Primer (HSPLGF_seg7F_WT
(SEQ ID NO: 394)):
TCGTGTCCGAGTACCCCAG

Reverse Primer (HSPLGF_seg7R_WT
(SEQ ID NO: 395)):
ACAGTGCAGATTCTCATCGCC

Amplicon (HSPLGF_seg7_WT (SEQ ID NO: 393)):
TCGTGTCCGAGTACCCCAGCGAGGTGGAGCACATGTTCAGCCCATC
CTGTGTCTCCCTGCTGCGCTGCACCGGCTGCTGCGGCGATGAGAAT
CTGCACTGT
```

Figure 17:
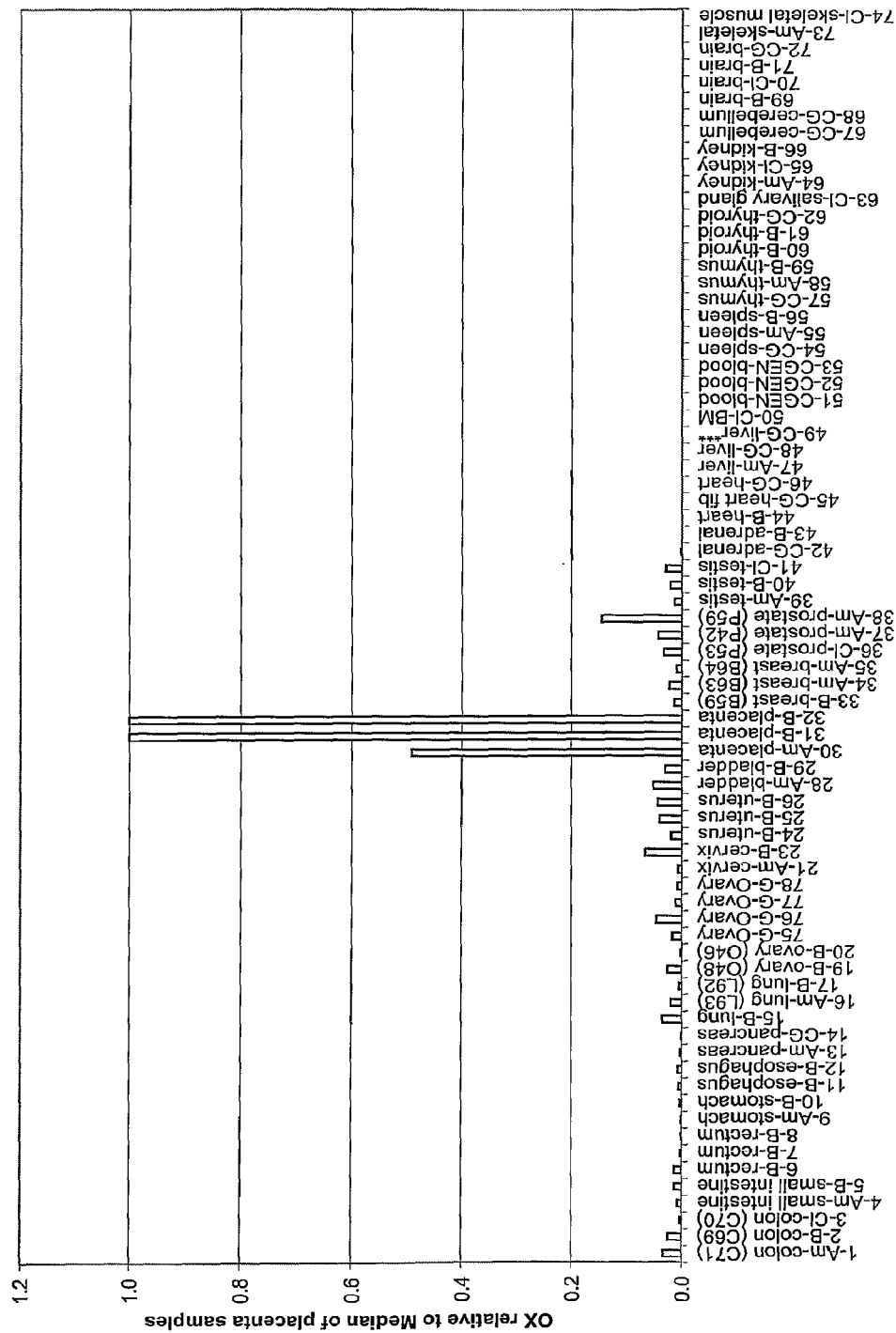
FIG. 17 shows expression of *Homo sapiens* placental growth factor, vascular endothelial growth factor-related protein (PGF) HSPLGF transcripts which are detectable by amplicon as depicted in sequence name HSPLGF_seg7WT (SEQ ID NO: 393) in different normal tissues.

Expression of *Homo sapiens* Placental Growth Factor, Vascular Endothelial Growth Factor-Related Protein (PGF) HSPLGF Transcripts which are Detectable by Amplicon as Depicted in Sequence Name HSPLGF_seg7WT (SEQ ID NO: 393) in Different Normal Tissues Expression of *Homo sapiens* placental growth factor, vascular endothelial growth factor-related protein (PGF) transcripts detectable by or according to seg7WT—HSPLGF_seg7WT (SEQ ID NO: 393) amplicon and primers HSPLGF_seg7WTF (SEQ ID NO: 394) and HSPLGF_seg7WTR (SEQ ID NO: 395) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the placenta samples (sample numbers 30, 31 and 32, Table 5 above), to obtain a value of relative expression of each sample relative to median of the placenta samples. FIG. 17 shows expression of *Homo sapiens* placental growth factor, vascular endothelial growth factor-related protein (PGF) HSPLGF transcripts which are detectable by amplicon as depicted in sequence name HSPLGF_seg7WT (SEQ ID NO: 393) in different normal tissues.

```
Forward Primer (HSPLGF_seg7WTF
(SEQ ID NO: 394)):
TCGTGTCCGAGTACCCCAG

Reverse Primer (HSPLGF_seg7WTR
(SEQ ID NO: 395)):
ACAGTGCAGATTCTCATCGCC

Amplicon (HSPLGF_seg7WT (SEQ ID NO: 393)):
TCGTGTCCGAGTACCCCAGCGAGGTGGAGCACATGTTCAGCCCATCC
TGTGTCTCCCTGCTGCGCTGCACCGGCTGCTGCGGCGATGAGAATCTG
CACTGT
```

Figure 18:
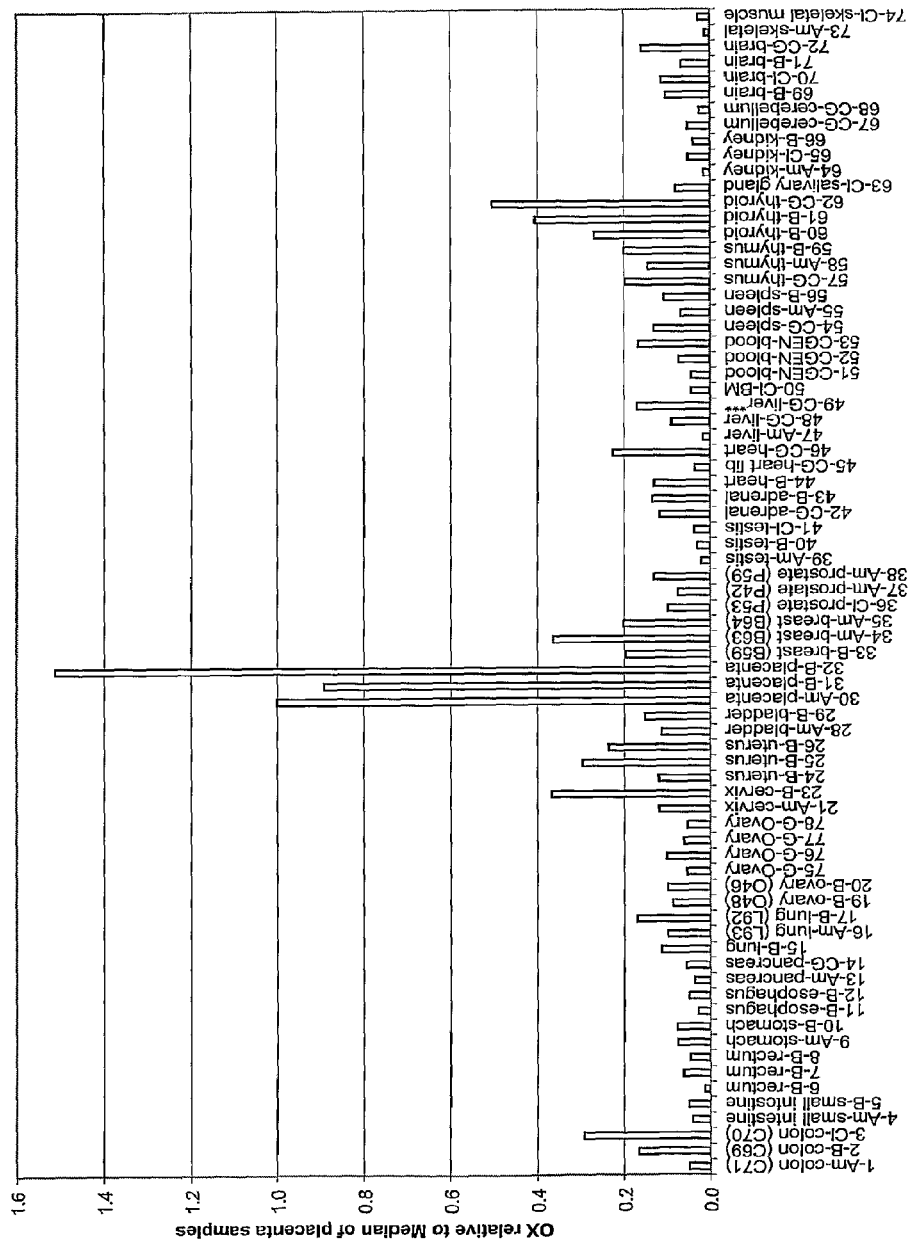
FIG. 18 shows expression of *Homo sapiens* placental growth factor, vascular endothelial growth factor-related protein (PlGF) HSPLGF transcripts which are detectable by amplicon as depicted in sequence name HSPLGF_seg15-16 (SEQ ID NO:396) in different normal tissues.

Expression of *Homo sapiens* Placental Growth Factor, Vascular Endothelial Growth Factor-Related Protein (PlGF) HSPLGF Transcripts which are Detectable by Amplicon as Depicted in Sequence Name HSPLGF_seg15-16 (SEQ ID NO:396) in Different Normal Tissues Expression of *Homo sapiens* placental growth factor, vascular endothelial growth factor-related protein (PlGF) transcripts detectable by or according to seg15-16—HSPLGF_seg15-16 (SEQ ID NO:396) amplicon and primers HSPLGF_seg15-16F (SEQ ID NO:397) and HSPLGF_seg15-16R (SEQ ID NO:398) was measured by real time PCR. In parallel the expression of four housekeeping genes— SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the placenta samples (sample numbers 30, 31 and 32, Table 5 above), to obtain a value of relative expression of each sample relative to median of the placenta samples. FIG. 18 shows expression of *Homo sapiens* placental growth factor, vascular endothelial growth factor-related protein (PlGF) HSPLGF transcripts which are detectable by amplicon as depicted in sequence name HSPLGF_seg15-16 (SEQ ID NO:396) in different normal tissues.

```
Forward Primer (HSPLGF_seg15-16F
(SEQ ID NO: 397)):
TGGTTTGGCTGGGGCTC

Reverse Primer (HSPLGF_seg15-16R
(SEQ ID NO: 398)):
CTGCAATAAGCCAAGCGTCAG

Amplicon (HSPLGF_seg15-16 (SEQ ID NO: 396)):
TGGTTTGGCTGGGGCTCGGGGCTATTCTCGGGCCTGCCAGCCTCTGTCC
TAGCATGGGGTTCCCCAGCCACCTTGTCCTGACGCTTGGCTTATTGCAG
```

Expression of *Homo sapiens* Placental Growth Factor, Vascular Endothelial Growth Factor-Related Protein (PlGF) HSPLGF Transcripts which are Detectable by Amplicon as Depicted in Sequence Name HSPLGF_seg16-21 (SEQ ID NO:399) in Normal and Cancerous Lung Tissues Expression of *Homo sapiens* placental growth factor, vascular endothelial growth factor-related protein (PlGF) transcripts detectable by or according to seg16-21—HSPLGF_seg16-21 (SEQ ID NO:399) amplicon and primers HSPLGF_seg16-21F (SEQ ID NO:400) and HSPLGF_seg16-21R (SEQ ID NO:401) was measured by real time PCR. In parallel the expression of four housekeeping genes— HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), SDHA (GenBank Accession No. NM_004168 (SEQ ID NO:364); amplicon—SDHA-amplicon (SEQ ID NO:365)) and Ubiquitin (GenBank Accession No. BC000449 (SEQ ID NO:366); amplicon—Ubiquitin-amplicon (SEQ ID NO:367)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold up-regulation for each sample relative to median of the normal PM samples.

Figure 19:
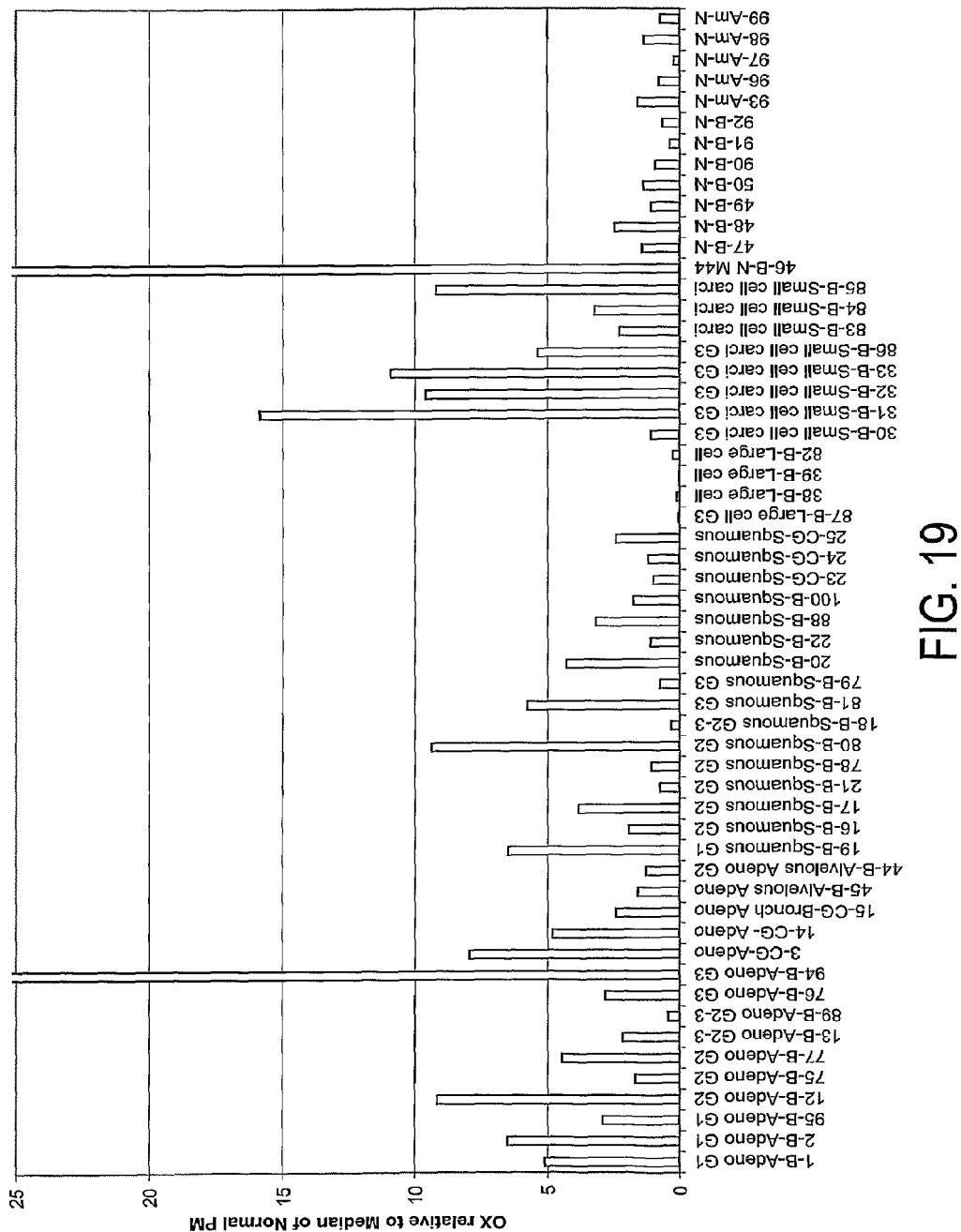
FIG. 19 is a histogram showing over expression of the above-indicated *Homo sapiens* placental growth factor, vascular endothelial growth factor-related protein (PGF) transcripts in cancerous Lung samples relative to the normal samples (seg16-21)

FIG. 19 is a histogram showing over expression of the above-indicated *Homo sapiens* placental growth factor, vascular endothelial growth factor-related protein (PGF) transcripts in cancerous Lung samples relative to the normal samples (seg16-21).

As is evident from FIG. 19, the expression of *Homo sapiens* placental growth factor, vascular endothelial growth factor-related protein (PlGF) transcripts detectable by the above amplicon in adenocarcinoma and small cell carcinoma samples was higher than in the non-cancerous samples (sample numbers 47, 48, 49, 50, 90, 91, 92, 93, 96, 97, 98 and 99, Table 3 above) and was higher in a few squamous cell carcinoma. Notably an over-expression of at least 5 fold was found in 5 out of 15 adenocarcinoma samples, in 3 out of 16 squamous cell carcinoma samples, in 5 out of 8 small cell carcinoma.

Statistical analysis was applied to verify the significance of these results, as described below.

The P value for the difference in the expression levels of *Homo sapiens* placental growth factor, vascular endothelial growth factor-related protein (PlGF) transcripts detectable by the above amplicon in Lung adenocarcinoma samples versus the normal tissue samples was determined by T test as 2.90e-002. The P value for the difference in the expression levels of *Homo sapiens* placental growth factor, vascular endothelial growth factor-related protein (PlGF) transcripts detectable by the above amplicon in Lung squamous cell carcinoma samples versus the normal tissue samples was determined by T test as 1.67e-002. The P value for the difference in the expression levels of *Homo sapiens* placental growth factor, vascular endothelial growth factor-related protein (PGF) transcripts detectable by the above amplicon in all Lung non-small cell carcinoma samples versus the normal tissue samples was determined by T test as 6.04e-003. The P value for the difference in the expression levels of *Homo sapiens* placental growth factor, vascular endothelial growth factor-related protein (PlGF) transcripts detectable by the above amplicon in Lung small cell carcinoma samples versus the normal tissue samples was determined by T test as 1.11e-002.

Threshold of 5 fold over expression was found to differentiate between adenocarcinoma and normal samples with P value of 3.72e-002 as checked by exact Fisher test. Threshold of 5 fold over expression was found to differentiate between small cell carcinoma and normal samples with P value of 3.61e-003 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: HSPLGF_seg16-21F (SEQ ID NO:400) forward primer; and HSPLGF_seg16-21R (SEQ ID NO:401) reverse primer.

The present invention also preferably encompasses any amplicon obtained through the use of any suitable primer pair; for example, for the above experiment, the following amplicon was obtained as a non-limiting illustrative example only of a suitable amplicon: HSPLGF_seg16-21 (SEQ ID NO:399).

```
Forward Primer (HSPLGF_seg16-21F
(SEQ ID NO: 400)):
CTTGTCCTGACGCTTGGCTTA

Reverse Primer (HSPLGF_seg16-21R
(SEQ ID NO: 401)):
GGGAACAGCATCGCCG

Amplicon HSPLGF_seg16-21
(SEQ ID NO: 399):
CTTGTCCTGACGCTTGGCTTATTGCAGGAGGAGACCCAAGGGCAGGG
GGAAGAGGAGGAGAGAGAAGCAGAGACCCACAGACTGCCACCTGTG
CGGCGATGCTGTTCCC
```

Expression of *Homo sapiens* Placental Growth Factor, Vascular Endothelial Growth Factor-Related Protein (PlGF) HSPLGF Transcripts which are Detectable by Amplicon as Depicted in Sequence Name HSPLGF_seg16-21 (SEQ ID NO:399) in Normal and Cancerous Colon Tissues Expression of *Homo sapiens* placental growth factor, vascular endothelial growth factor-related protein (PlGF) transcripts detectable by or according to seg16-21—HSPLGF_seg16-21 (SEQ ID NO:399) amplicon and primers HSPLGF_seg16-21F (SEQ ID NO:400) and HSPLGF_seg16-21R (SEQ ID NO:401) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), RPS27A (GenBank Accession No. NM_002954 (SEQ ID NO:403); RPS27A (SEQ ID NO:402) amplicon) and G6PD (GenBank Accession No. NM_000402 (SEQ ID NO:405); G6PD (SEQ ID NO:404) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 41, 52, 63, 64, 65, 66, 67, 69, 70 and 71, Table 2 above), to obtain a value of fold up-regulation for each sample relative to median of the normal PM samples.

Figure 20:
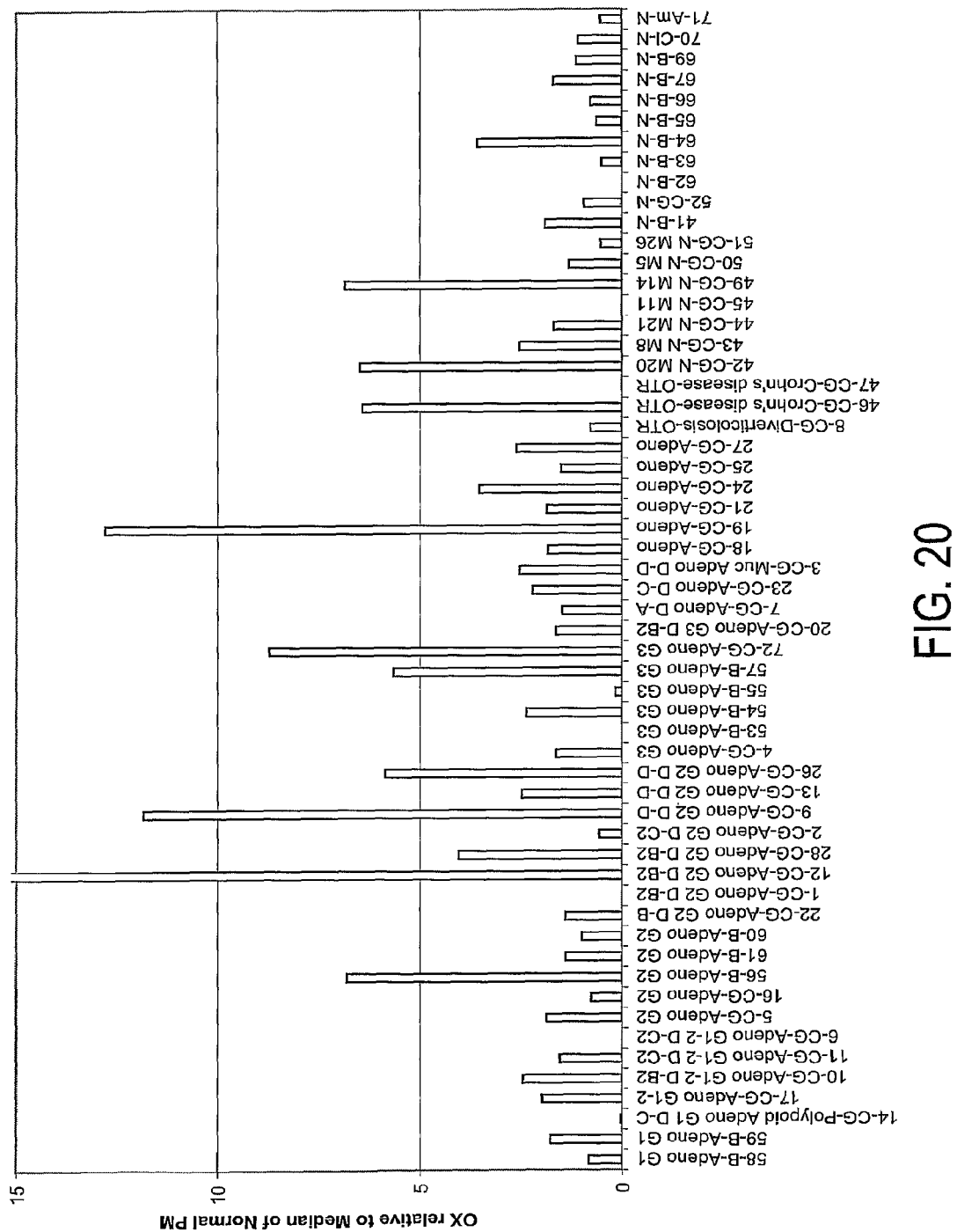
FIG. 20 is a histogram showing over expression of the above-indicated *Homo sapiens* placental growth factor, vascular endothelial growth factor-related protein (PGF) transcripts in cancerous colon samples relative to the normal samples (seg16-21)

FIG. 20 is a histogram showing over expression of the above-indicated *Homo sapiens* placental growth factor, vascular endothelial growth factor-related protein (PGF) transcripts in cancerous Colon samples relative to the normal samples (seg16-21).

As is evident from FIG. 20, the expression of *Homo sapiens* placental growth factor, vascular endothelial growth factor-related protein (PGF) transcripts detectable by the above amplicon in cancer samples was higher than in the non-cancerous samples (sample numbers 41, 52, 63, 64, 65, 66, 67, 69, 70 and 71, Table 2 above). Notably an over-expression of at least 5 fold was found in 7 out of 33 adenocarcinoma samples.

Statistical analysis was applied to verify the significance of these results, as described below.

The P value for the difference in the expression levels of *Homo sapiens* placental growth factor, vascular endothelial growth factor-related protein (PlGF) transcripts detectable by the above amplicon in Colon cancer samples versus the normal tissue samples was determined by T test as 9.07e-003.

The above values demonstrate statistical significance of the results.

Primer pairs are also optionally and preferably encompassed within the present invention; for example, for the above experiment, the following primer pair was used as a non-limiting illustrative example only of a suitable primer pair: HSPLGF_seg16-21F (SEQ ID NO:400) forward primer; and HSPLGF_seg16-21R (SEQ ID NO:401) reverse primer.

The present invention also preferably encompasses any amplicon obtained through the use of any suitable primer pair; for example, for the above experiment, the following amplicon was obtained as a non-limiting illustrative example only of a suitable amplicon: HSPLGF_seg16-21 (SEQ ID NO:399).

```
Forward Primer (HSPLGF_seg16-21F
(SEQ ID NO: 400)):
CTTGTCCTGACGCTTGGCTTA

Reverse Primer (HSPLGF_seg16-21R
(SEQ ID NO: 401)):
GGGAACAGCATCGCCG

Amplicon (HSPLGF_seg16-21 (SEQ ID NO: 399)):
CTTGTCCTGACGCTTGGCTTATTGCAGGAGGAGACCCAAGGGCAGGGGG
AAGAGGAGGAGAGAGAAGCAGAGACCCACAGACTGCCACCTGTGCGGC
GATGCTGTTCCC
```

Figure 21:
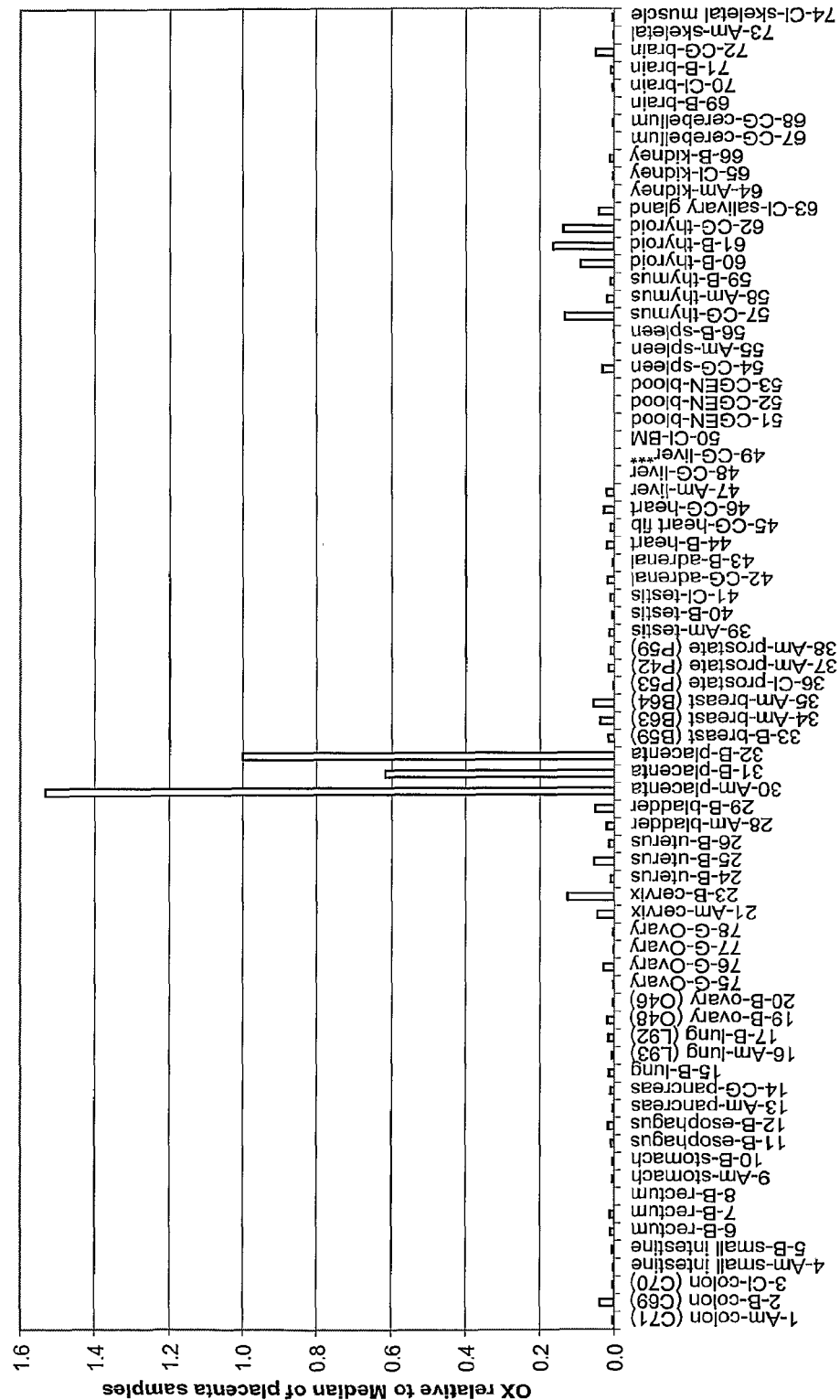
FIG. 21 shows expression of *Homo sapiens* placental growth factor, vascular endothelial growth factor-related protein (PlGF) HSPLGF transcripts which are detectable by amplicon as depicted in sequence name HSPLGF_seg16-21 (SEQ ID NO:399) in different normal tissues.

Expression of *Homo sapiens* Placental Growth Factor, Vascular Endothelial Growth Factor-Related Protein (PlGF) HSPLGF Transcripts which are Detectable by Amplicon as Depicted in Sequence Name HSPLGF_seg16-21 (SEQ ID NO:399) in Different Normal Tissues Expression of *Homo sapiens* placental growth factor, vascular endothelial growth factor-related protein (PlGF) transcripts detectable by or according to seg16-21—HSPLGF_seg16-21 (SEQ ID NO:399) amplicon and primers HSPLGF_seg16-21F (SEQ ID NO:400) and HSPLGF_seg16-21R (SEQ ID NO:401) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the placenta samples (sample numbers 30, 31 and 32, Table 5 above), to obtain a value of relative expression of each sample relative to median of the placenta samples. FIG. 21 shows expression of *Homo sapiens* placental growth factor, vascular endothelial growth factor-related protein (PlGF) HSPLGF transcripts which are detectable by amplicon as depicted in sequence name HSPLGF_seg16-21 (SEQ ID NO:399) in different normal tissues.

```
Forward Primer (HSPLGF_seg16-21F
(SEQ ID NO: 400)):
CTTGTCCTGACGCTTGGCTTA

Reverse Primer (HSPLGF_seg16-21R
(SEQ ID NO: 401)):
GGGAACAGCATCGCCG

Amplicon (HSPLGF_seg16-21
(SEQ ID NO: 399)):
CTTGTCCTGACGCTTGGCTTATTGCAGGAGGAGACCCAAGGGCAGGGG
GAAGAGGAGGAGAGAGAAGCAGAGACCCACAGACTGCCACCTGTGC
GGCGATGCTGTTCCC
```

*Homo sapiens* placental growth factor, vascular endothelial growth factor-related protein (PGF) HSPLGF transcripts which are detectable by amplicon as depicted in sequence name HSPLGF_seg7WT (SEQ ID NO: 393) and primers HSPLGF_seg7WT-F (SEQ ID NO: 394) and HSPLGF_seg7WT-R (SEQ ID NO: 395) did not show any differential expression in one experiment carried out with each of the following cancer panels: breast cancer, colon cancer and ovary cancer.

*Homo sapiens* placental growth factor, vascular endothelial growth factor-related protein (PGF) HSPLGF transcripts which are detectable by amplicon as depicted in sequence name HSPLGF_seg15-16 (SEQ ID NO:396) and primers HSPLGF_seg15-16-F (SEQ ID NO: 397) and HSPLGF_seg15-16-R (SEQ ID NO: 398) did not show any differential expression in one experiment carried out with colon cancer panel.

*Homo sapiens* placental growth factor, vascular endothelial growth factor-related protein (PGF) HSPLGF transcripts which are detectable by amplicon as depicted in sequence name HSPLGF_seg16-21 (SEQ ID NO:399) and primers HSPLGF_seg16-21-F (SEQ ID NO: 400) and HSPLGF_seg16-21-R (SEQ ID NO: 401) did not show any differential expression in one experiment carried out with each of the following cancer panels: breast cancer and ovary cancer.

Description for Cluster HUMSP18A

Cluster HUMSP18A features 13 transcript(s) and 50 segment(s) of interest, the names for which are given in Tables 131 and 132, respectively. The selected protein variants are given in table 133.

TABLE 131

| Transcripts of interest |
|---|
| Transcript Name |
| HUMSP18A_T14 (SEQ ID NO: 114) |
| HUMSP18A_T15 (SEQ ID NO: 115) |
| HUMSP18A_T20 (SEQ ID NO: 116) |
| HUMSP18A_T23 (SEQ ID NO: 117) |
| HUMSP18A_T27 (SEQ ID NO: 118) |
| HUMSP18A_T29 (SEQ ID NO: 119) |
| HUMSP18A_T30 (SEQ ID NO: 120) |

TABLE 131-continued

| Transcripts of interest |
|---|
| Transcript Name |
| HUMSP18A_T34 (SEQ ID NO: 121) |
| HUMSP18A_T35 (SEQ ID NO: 122) |
| HUMSP18A_T38 (SEQ ID NO: 123) |
| HUMSP18A_T42 (SEQ ID NO: 124) |
| HUMSP18A_T44 (SEQ ID NO: 125) |
| HUMSP18A_T46 (SEQ ID NO: 126) |

TABLE 132

| Segments of interest |
|---|
| Segment Name |
| HUMSP18A_N2 (SEQ ID NO: 140) |
| HUMSP18A_N9 (SEQ ID NO: 143) |
| HUMSP18A_N15 (SEQ ID NO: 148) |
| HUMSP18A_N17 (SEQ ID NO: 150) |
| HUMSP18A_N26 (SEQ ID NO: 158) |
| HUMSP18A_N28 (SEQ ID NO: 160) |
| HUMSP18A_N29 (SEQ ID NO: 161) |
| HUMSP18A_N31 (SEQ ID NO: 163) |
| HUMSP18A_N32 (SEQ ID NO: 164) |
| HUMSP18A_N44 (SEQ ID NO: 172) |
| HUMSP18A_N67 (SEQ ID NO: 183) |
| HUMSP18A_N68 (SEQ ID NO: 184) |
| HUMSP18A_N69 (SEQ ID NO: 185) |
| HUMSP18A_N70 (SEQ ID NO: 186) |
| HUMSP18A_N72 (SEQ ID NO: 188) |
| HUMSP18A_N0 (SEQ ID NO: 139) |
| HUMSP18A_N5 (SEQ ID NO: 141) |
| HUMSP18A_N6 (SEQ ID NO: 142) |
| HUMSP18A_N10 (SEQ ID NO: 144) |
| HUMSP18A_N11 (SEQ ID NO: 145) |
| HUMSP18A_N13 (SEQ ID NO: 146) |
| HUMSP18A_N14 (SEQ ID NO: 147) |
| HUMSP18A_N16 (SEQ ID NO: 149) |
| HUMSP18A_N18 (SEQ ID NO: 151) |
| HUMSP18A_N19 (SEQ ID NO: 152) |
| HUMSP18A_N20 (SEQ ID NO: 153) |
| HUMSP18A_N21 (SEQ ID NO: 154) |
| HUMSP18A_N22 (SEQ ID NO: 155) |
| HUMSP18A_N23 (SEQ ID NO: 156) |

TABLE 132-continued

Segments of interest
Segment Name

HUMSP18A_N25 (SEQ ID NO: 157)

HUMSP18A_N27 (SEQ ID NO: 159)

HUMSP18A_N30 (SEQ ID NO: 162)

HUMSP18A_N33 (SEQ ID NO: 165)

HUMSP18A_N34 (SEQ ID NO: 166)

HUMSP18A_N35 (SEQ ID NO: 167)

HUMSP18A_N36 (SEQ ID NO: 168)

HUMSP18A_N37 (SEQ ID NO: 169)

HUMSP18A_N38 (SEQ ID NO: 170)

HUMSP18A_N39 (SEQ ID NO: 171)

HUMSP18A_N45 (SEQ ID NO: 173)

HUMSP18A_N46 (SEQ ID NO: 174)

HUMSP18A_N50 (SEQ ID NO: 175)

HUMSP18A_N51 (SEQ ID NO: 176)

HUMSP18A_N52 (SEQ ID NO: 177)

HUMSP18A_N62 (SEQ ID NO: 178)

HUMSP18A_N63 (SEQ ID NO: 179)

HUMSP18A_N64 (SEQ ID NO: 180)

HUMSP18A_N65 (SEQ ID NO: 181)

HUMSP18A_N66 (SEQ ID NO: 182)

HUMSP18A_N71 (SEQ ID NO: 187)

TABLE 133

Proteins of interest

| Protein Name | Corresponding Transcript(s) |
|---|---|
| HUMSP18A_P3 (SEQ ID NO: 127) | HUMSP18A_T14 (SEQ ID NO: 114); HUMSP18A_T30 (SEQ ID NO: 120) |
| HUMSP18A_P20 (SEQ ID NO: 128) | HUMSP18A_T44 (SEQ ID NO: 125) |
| HUMSP18A_P22 (SEQ ID NO: 129) | HUMSP18A_T46 (SEQ ID NO: 126) |
| HUMSP18A_P38 (SEQ ID NO: 130) | HUMSP18A_T14 (SEQ ID NO: 114); HUMSP18A_T30 (SEQ ID NO: 120) |
| HUMSP18A_P39 (SEQ ID NO: 131) | HUMSP18A_T15 (SEQ ID NO: 115); HUMSP18A_T27 (SEQ ID NO: 118) |
| HUMSP18A_P41 (SEQ ID NO: 132) | HUMSP18A_T20 (SEQ ID NO: 116) |
| HUMSP18A_P43 (SEQ ID NO: 133) | HUMSP18A_T23 (SEQ ID NO: 117) |
| HUMSP18A_P45 (SEQ ID NO: 134) | HUMSP18A_T29 (SEQ ID NO: 119) |
| HUMSP18A_P48 (SEQ ID NO: 135) | HUMSP18A_T34 (SEQ ID NO: 121) |
| HUMSP18A_P49 (SEQ ID NO: 136) | HUMSP18A_T35 (SEQ ID NO: 122) |
| HUMSP18A_P50 (SEQ ID NO: 137) | HUMSP18A_T38 (SEQ ID NO: 123) |
| HUMSP18A_P53 (SEQ ID NO: 138) | HUMSP18A_T42 (SEQ ID NO: 124) |

These sequences are variants of the known protein Pulmonary surfactant-associated protein B precursor (SwissProt accession identifier PSPB_HUMAN (SEQ ID NO:406); known also according to the synonyms SP-B; 6 kDa protein; Pulmonary surfactant-associated proteolipid SPL(Phe); 18 kDa pulmonary-surfactant protein), referred to herein as the previously known protein.

Protein Pulmonary surfactant-associated protein B precursor is known or believed to have the following function(s): Pulmonary surfactant-associated proteins promote alveolar stability by lowering the surface tension at the air-liquid interface in the peripheral air spaces. SP-B increases the collapse pressure of palmitic acid to nearly 70 millinewtons per meter. Known polymorphisms for this sequence are as shown in Table 134.

TABLE 134

Amino acid mutations for Known Protein

| SNP position(s) on amino acid sequence | Comment |
|---|---|
| 131 | T -> I (in dbSNP:1130866). /FTId=VAR_006948 |
| 176 | L -> F (in dbSNP:3024801). /FTId=VAR_013099 |
| 228 | A -> R. /FTId=VAR_006949 |
| 228 | A -> I. /FTId=VAR_006950 |
| 272 | R -> H (in dbSNP:3024809). /FTId=VAR_013100 |
| 178 | L -> V |
| 318 | P -> L |

Protein Pulmonary surfactant-associated protein B precursor localization is believed to be extracellular.

The following GO Annotation(s) apply to the previously known protein. The following annotation(s) were found: organogenesis; respiratory gaseous exchange, which are annotation(s) related to Biological Process.

The GO assignment relies on information from one or more of the SwissProt/TremBl Protein knowledgebase or Locuslink.

According to optional embodiments of the present invention, variants of this cluster according to the present invention (amino acid and/or nucleic acid sequences of HUMSP18A) may optionally have one or more of the following utilities, as described with regard to the Table below. It should be noted that these utilities are optionally and preferably suitable for human and non-human animals as subjects, except where otherwise noted. The reasoning is described with regard to biological and/or physiological and/or other information about the known protein, but is given to demonstrate particular diagnostic utility for the variants according to the present invention.

Pulmonary surfactant-associated protein B play an important role in the stability and spreading of surfactant lipids in the alveolus. Deletion or mutations in SP-B cause acute and chronic lung disease (Biol Neonate. 2005; 87(4):283-7. Epub 2005 Jun. 1). Also see below:

TABLE 135

Utilities for Variants of HUMSP18A, related to Pulmonary surfactant-associated protein B

| Dx field | Explanation | Ref |
| --- | --- | --- |
| A marker for Lung function/damage/respiratory failure | Partial SP-B deficiency perturbs lung function and causes respiratory failure | Am J Physiol Lung Cell Mol Physiol. 2005 June; 288(6): L1154-61. Epub 2005 Feb. 18 Crit Care Med. 2004 May; 32(5): 1115-9 J Perinat Neonatal Nurs. 2004 January-March; 18(1): 61-7. |
| Surrogate marker for lung adenocarcinoma treatment | Dexamethasone and betamethasone affect surfactant protein-B messenger RNA expression in human type II pneumocytes and human lung adenocarcinoma cells | Am J Obstet Gynecol. 2004 April; 190(4): 952-9 |
| A biomarker in chronic heart failure A surrogate marker for the effect of diuretics on CHF | Plasma SP-B was elevated in CHF (P < 0.001), and levels increased with New York Heart Association classification (P < 0.001). SP-B levels are correlated with clinical severity. During follow-up, major cardiovascular events occurred in patients with higher plasma SP-B (P < 0.01) and NT-proBNP (P < 0.05). Furthermore, on conditional logistic regression analysis, only SP-B was independently associated with CHF hospitalization (P = 0.005). Therefore, it may be a clinically useful biomarker of the pulmonary consequences of raised P(mv). When the diuretic dosage was increased on clinical grounds, SP-B had increased 39% (P < 0.001) | Circulation. 2004 Aug. 31; 110(9): 1091-6. Epub 2004 Aug. 9 |

According to other optional embodiments of the present invention, variants of this cluster according to the present invention (amino acid and/or nucleic acid sequences of HUMSP18A) may optionally have one or more of the following utilities, some of which are related to utilities described above. It should be noted that these utilities are optionally and preferably suitable for human and non-human animals as subjects, except where otherwise noted.

A non-limiting example of such a utility is using this marker as a surrogate marker for determining the efficacy of treatment for various lung and cardiovascular disorders, including but not limited to the following: lung cancer, lung function failure. The surrogate marker according to the present invention could be measured in subjects undergoing treatment including but not limited to the following: treatment of lung cancer by surgery, radiation and/or chemotherapy. The most commonly used chemotherapeutic agents for the treatment of lung cancer include but are not limited to Platinol® (Generic Name: Cisplatin), VP-16; VePesid® (Generic Name: Etoposide), Paraplatin® (Generic Name: Carboplatin), Taxol® (Generic Name: Paclitaxel), Taxotere® (Generic Name: Docetaxel), Navelbine® (Generic Name: Vinorelbine tartrate), Adriamycin® (Generic Name: Doxorubicin), Oncovin® (Generic Name: Vincristine sulfate), Ifex® (Generic Name: Ifosfamide), Gemzar® (Generic Name: Gemcitabine hydrochloride). Standard chemotherapy for lung cancer typically consists of combinations of two or more of these drugs. Such combination therapy has been shown to improve the overall response to treatment. Well-known drug pairings in combination therapy include: paclitaxel plus carboplatin; cisplatin plus vinorelbine tartrate; cisplatin plus VP-16; and carboplatin plus VP-16. Concurrent radiotherapy is very often used with the combinations of cisplatin plus VP-16 or carboplatin plus VP-16. Other chemotherapeutic agents that may be used to treat lung cancer during clinical trials or alternative programs are: Cytoxan® (Generic Name: Cyclophosphamide); Methotrexate (Generic Name: Methotrexate); CeeNu® (Generic Name: Lomustine (CCNU)) and Hycamtin™ (Generic Name: Topotecan.hydrochloride).

The surrogate marker according to the present invention could be measured in subjects undergoing treatment including but not limited to the following: treatments of lung function failure using respiration with oxygen (plus PEEP pressure), steroids, surfactant, inhaled nitric oxide.

Another non-limiting example of diagnostic utility of one or more HSACMHCP variants according to the present invention may optionally be detection of Lung Adenocarcinoma, as described for example in Bhattacharjee A, et al (Proc Natl Acad Sci USA. 2001 Nov. 20; 98(24):13790-5) through microarrays.

Other non-limiting exemplary utilities for HUMSP18A variants according to the present invention are described in greater detail below and also with regard to the previous section on clinical utility.

As noted above, cluster HUMSP18A features 13 transcript(s), which were listed in Table 131 above. These transcript(s) encode for protein(s) which are variant(s) of protein Pulmonary surfactant-associated protein B precursor. A description of each variant protein according to the present invention is now provided.

Variant protein HUMSP18A_P3 (SEQ ID NO:127) according to the present invention has an amino acid sequence as given at the end of the application; it is encoded by transcript(s) HUMSP18A_T14 (SEQ ID NO:114) and HUMSP18A_T30 (SEQ ID NO:120). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P3 (SEQ ID NO:127) and PSPB_HUMAN (SEQ ID NO:406):

A. An isolated chimeric polypeptide as set forth in HUMSP18A_P3 (SEQ ID NO:127), comprising a first amino acid sequence being at least 70%, optionally at least 80%, preferably at least 85%, more preferably at least 90% and most preferably at least 95%, homologous to a polypeptide having the sequence MHQAGYPGCRGA (SEQ ID NO: 582) corresponding to amino acids 1-12 of HUMSP18A_P3 (SEQ ID NO:127), a second amino acid sequence being at least 90% homologous to MAESHLLQWLLLLLPTLCGPG-TAAWTTSSLACAQGPEFWC-QSLEQALQCRALGHCLQEVWGHVGADDLCQE CEDIVHILNKMAKEAIFQDTMRK-FLEQECNVLPLKLLMPQCNQVLDDYF-PLVIDYFQNQTDSNGICMHLGLCK SRQPEP-EQEPGMSDPLPKPLRDPLPDPLLDKLVLPVLPGALQ-ARPGPHTQDLSEQQFPIPLPYCWLCRALIKRIQA MIP-KGALAVAVAQVCRVVPLVAGGICQ-CLAERYSVILLDTLLGRMLPQLVCRLVL-RCSMDDSAGP corresponding to amino acids 1-285 of PSPB_HUMAN (SEQ ID NO:406), which also corresponds to amino acids 13-297 of HUMSP18A_P3 (SEQ ID NO:127), and a third amino acid sequence being at least 70%, optionally at least 80%, preferably at least 85%, more preferably at least 90% and most preferably at least 95% homologous to a polypeptide having the sequence SEPTAPSLAQ-CLLSSSPYPATA (SEQ ID NO: 481) corresponding to amino acids 298-319 of HUMSP18A_P3 (SEQ ID NO:127), wherein said first amino acid sequence, second amino acid sequence and third amino acid sequence are contiguous and in a sequential order.

B. An isolated polypeptide encoding for a head of HUMSP18A_P3 (SEQ ID NO:127), comprising a polypeptide being at least 70%, optionally at least about 80%, preferably at least about 85%, more preferably at least about 90% and most preferably at least about 95% homologous to the sequence MHQAGYPGCRGA (SEQ ID NO: 582) of HUMSP18A_P3 (SEQ ID NO:127).

C. An isolated polypeptide encoding for an edge portion of HUMSP18A_P3 (SEQ ID NO:127), comprising an amino acid sequence being at least 70%, optionally at least about 80%, preferably at least about 85%, more preferably at least about 90% and most preferably at least about 95% homolo-gous to the sequence SEPTAPSLAQCLLSSSPYPATA (SEQ ID NO: 481) of HUMSP18A_P3 (SEQ ID NO:127).

The location of the variant protein was determined according to results from a number of different software programs and analyses, including analyses from SignalP and other specialized programs. The variant protein is secreted.

Variant protein HUMSP18A_P3 (SEQ ID NO:127) also has the following non-silent SNPs (Single Nucleotide Polymorphisms) as listed in Table 136, (given according to their position(s) on the amino acid sequence, with the alternative amino acid(s) listed; the presence of known SNPs in variant protein HUMSP18A_P3 (SEQ ID NO:127) sequence provides support for the deduced sequence of this variant protein according to the present invention).

TABLE 136

Amino acid mutations

| SNP position(s) on nucleotide sequence | Alternative amino acid(s) |
|---|---|
| 2 | H -> P |
| 16 | S -> |
| 27 | P -> L |
| 46 | Q -> |
| 72 | W -> * |
| 110 | Q -> R |
| 131 | Y -> F |
| 134 | L -> |
| 143 | T -> I |
| 172 | L -> |
| 172 | L -> Q |
| 178 | D -> |
| 188 | L -> F |
| 196 | A -> |
| 201 | P -> |
| 211 | Q -> L |
| 220 | C -> Y |
| 227 | I -> N |
| 234 | I -> V |
| 240 | A -> G |
| 240 | A -> P |
| 255 | G -> |
| 255 | G -> D |
| 275 | G -> |
| 276 | R -> |
| 284 | R -> H |
| 292 | D -> G |
| 303 | P -> H |
| 309 | L -> P |

The glycosylation sites of variant protein HUMSP18A_P3 (SEQ ID NO:127), as compared to the known protein Pulmonary surfactant-associated protein B precursor, are described in Table 137 (given according to their position(s) on the amino acid sequence in the first column; the second column indicates whether the glycosylation site is present in the variant protein; and the last column indicates whether the position is different on the variant protein).

TABLE 137

Glycosylation site(s)

| Position(s) on known amino acid sequence | Present in variant protein? | Position(s) on variant protein |
|---|---|---|
| 141 | Yes | 153 |
| 311 | No | |

Variant protein HUMSP18A_P3 (SEQ ID NO:127) is encoded by the following transcript(s): HUMSP18A_T14 (SEQ ID NO:114) and HUMSP18A_T30 (SEQ ID NO:120), for which the coding portion starts at position 101 and ends at position 1057. The transcript also has the following SNPs as listed in Table 138 (given according to their position on the nucleotide sequence, with the alternative nucleic acid listed; the presence of known SNPs in variant protein HUMSP18A_P3 (SEQ ID NO:127) sequence provides support for the deduced sequence of this variant protein according to the present invention).

TABLE 138

Nucleic acid SNPs

| Polymorphism | SNP position(s) on nucleotide sequence |
|---|---|
| G -> A | 95, 184, 316, 427, 759, 864, 951, 1176, 3115, 3225, 3302 |
| A -> C | 105, 2622 |
| T -> | 146 |
| C -> T | 180, 208, 466, 528, 662, 979, 1937, 2046, 2311, 3189, 3246 |
| G -> | 238, 864, 924, 1248, 2207 |
| A -> G | 429, 800, 1021, 975, 1689, 1925, 2266, 3232, 3244 |
| A -> T | 492, 732, 1957 |
| C -> | 500, 687, 701, 614, 634, 928, 1353, 2440 |
| T -> A | 615, 780 |
| G -> C | 818, 2115 |
| C -> G | 819, 1612, 2210, 3333 |
| T -> G | 820, 3199, 3236 |
| T -> C | 820, 3205, 1026 |
| C -> A | 1008, 3333 |
| G -> T | 1600, 3325 |
| C -> T | 1805 |
| A -> | 1955 |

The coding portion of transcript HUMSP18A_T30 (SEQ ID NO:120) starts at position 101 and ends at position 1057. The transcript also has the following SNPs as listed in Table 139 (given according to their position on the nucleotide sequence, with the alternative nucleic acid listed; the presence of known SNPs in variant protein HUMSP18A_P3 (SEQ ID NO:127) sequence provides support for the deduced sequence of this variant protein according to the present invention).

TABLE 139

Nucleic acid SNPs

| Polymorphism | SNP position(s) on nucleotide sequence |
|---|---|
| G -> A | 95, 184, 316, 427, 759, 864, 951, 1176, 1324, 3285, 3395, 3472 |
| A -> C | 105, 2792 |
| T -> | 146 |
| C -> T | 180, 208, 466, 528, 662, 979, 1975, 2107, 2216, 2481, 3359, 3416 |
| G -> | 238, 864, 924, 1248, 2377 |
| A -> G | 429, 800, 975, 1021, 1859, 2095, 2436, 3402, 3414 |
| A -> T | 492, 732, 2127 |
| C -> | 500, 614, 634, 687, 701, 928, 1523, 2610 |
| T -> A | 615, 780 |
| G -> C | 818, 2285 |
| C -> G | 819, 1782, 2380, 3503 |
| T -> G | 820, 3369, 3406 |
| T -> C | 820, 1026, 3375 |
| C -> A | 1008, 3503 |
| G -> T | 1770, 3495 |
| A -> | 2125 |

Variant protein HUMSP18A_P20 (SEQ ID NO:128) according to the present invention has an amino acid sequence as given at the end of the application; it is encoded by transcript(s) HUMSP18A_T44 (SEQ ID NO:125). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P20 (SEQ ID NO:128) and PSPB_HUMAN (SEQ ID NO:406):

A. An isolated chimeric polypeptide as set forth in HUMSP18A_P20 (SEQ ID NO:128), comprising a first amino acid sequence being at least 70%, optionally at least 80%, preferably at least 85%, more preferably at least 90% and most preferably at least 95%, homologous to a polypeptide having the sequence MDEMGQVGLVGSCMCLGVL-CWPLPKRTSPLELGASPTHVSSTLGPLPPQ (SEQ ID NO: 583) corresponding to amino acids 1-49 of HUMSP18A_P20 (SEQ ID NO:128), and a second amino acid sequence being at least 90% homologous to DDL-CQECEDIVHILNKMAKEAIFQDTMRK-FLEQECNVLPLKLLMPQCNQVLDDYF-PLVIDYFQNQTDSNGICM HLGLCKSRQPEPEQEPGMSDPLPKPLRD-PLPDPLLDKLVLPVLPGALQARPGPH-TQDLSEQQFPIPLPYCWLCRA LIKRIQAMIPKGALA-VAVAQVCRVVPLVAGGICQCLAERYSVILLDTLLGR-MLPQLVCRLVLRCSMDDSAGPRS PTGEWLPRD-SECHLCMSVTTQAGNSSEQAIPQAM-LQACVGSWLDREKCKQFVEQHT-PQLLTLVPRGWDAHTT CQALGVCGTMSSPLQCIHSPDL corresponding to amino acids 66-381 of PSPB_HUMAN (SEQ ID NO:406), which also corresponds to amino acids 50-365 of HUMSP18A_P20 (SEQ ID NO:128), wherein said first amino acid sequence and second amino acid sequence are contiguous and in a sequential order.

B. An isolated polypeptide encoding for a head of HUMSP18A_P20 (SEQ ID NO:128), comprising a polypeptide being at least 70%, optionally at least about 80%, preferably at least about 85%, more preferably at least about 90% and most preferably at least about 95% homologous to the sequence MDEMGQVGLVGSCMCLGVLCWPLP-KRTSPLELGASPTHVSSTLGPLPPQ (SEQ ID NO: 583) of HUMSP18A_P20 (SEQ ID NO:128).

The location of the variant protein was determined according to results from a number of different software programs and analyses, including analyses from SignalP and other specialized programs. The variant protein is secreted.

Variant protein HUMSP18A_P20 (SEQ ID NO:128) also has the following non-silent SNPs (Single Nucleotide Polymorphisms) as listed in Table 140, (given according to their position(s) on the amino acid sequence, with the alternative amino acid(s) listed; the presence of known SNPs in variant protein HUMSP18A_P20 (SEQ ID NO:128) sequence provides support for the deduced sequence of this variant protein according to the present invention).

TABLE 140

Amino acid mutations

| SNP position(s) on amino acid sequence | Alternative amino acid(s) |
|---|---|
| 47 | P -> H |
| 82 | Q -> R |
| 103 | Y -> F |
| 106 | L -> |
| 115 | T -> I |
| 144 | L -> |
| 144 | L -> Q |
| 150 | D -> |
| 160 | L -> F |
| 168 | A -> |

TABLE 140-continued

Amino acid mutations

| SNP position(s) on amino acid sequence | Alternative amino acid(s) |
|---|---|
| 173 | P -> |
| 183 | Q -> L |
| 192 | C -> Y |
| 199 | I -> N |
| 206 | I -> V |
| 212 | A -> G |
| 212 | A -> P |
| 227 | G -> |
| 227 | G -> D |
| 247 | G -> |
| 248 | R -> |
| 256 | R -> H |
| 264 | D -> G |
| 274 | G -> R |
| 298 | E -> |
| 333 | L -> |

The glycosylation sites of variant protein HUMSP18A_P20 (SEQ ID NO:128), as compared to the known protein Pulmonary surfactant-associated protein B precursor, are described in Table 141 (given according to their position(s) on the amino acid sequence in the first column; the second column indicates whether the glycosylation site is present in the variant protein; and the last column indicates whether the position is different on the variant protein).

TABLE 141

Glycosylation site(s)

| Postion(s) on known amino acid sequence | Present in variant protein? | Position(s) on variant protein |
|---|---|---|
| 178 | Yes | 162 |
| 360 | Yes | 344 |

Variant protein HUMSP18A_P20 (SEQ ID NO:128) is encoded by the following transcript(s): HUMSP18A_T44 (SEQ ID NO:125), for which the coding portion starts at position 108 and ends at position 1202. The transcript also has the following SNPs as listed in Table 142 (given according to their position on the nucleotide sequence, with the alternative nucleic acid listed; the presence of known SNPs in variant protein HUMSP18A_P20 (SEQ ID NO:128) sequence provides support for the deduced sequence of this variant protein according to the present invention).

TABLE 142

Nucleic acid SNPs

| Polymorphism | SNP position(s) on nucleotide sequence |
|---|---|
| C -> A | 247, 3084 |
| G -> A | 350, 682, 787, 874, 927, 2866, 2976, 3053 |
| A -> G | 352, 723, 898, 1440, 1676, 2017, 2983, 2995 |
| C -> T | 389, 451, 585, 902, 1556, 1688, 1797, 2062, 2940, 2997 |
| A -> T | 415, 655, 1708 |
| C -> | 423, 537, 610, 624, 851, 557, 1104, 2191 |
| T -> A | 538, 703 |
| G -> C | 741, 1866 |
| C -> G | 742, 1363, 1961, 3084 |
| T -> G | 743, 2950, 2987 |
| T -> C | 743, 2956 |
| G -> | 787, 847, 999, 1958 |
| G -> T | 1351, 3076 |
| A -> | 1706 |
| A -> C | 2373 |

Variant protein HUMSP18A_P22 (SEQ ID NO:129) according to the present invention has an amino acid sequence as given at the end of the application; it is encoded by transcript(s) HUMSP18A_T46 (SEQ ID NO:126). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P22 (SEQ ID NO:129) and PSPB_HUMAN (SEQ ID NO:406):

A. An isolated chimeric polypeptide as set forth in HUMSP18A_P22 (SEQ ID NO:129), comprising a first amino acid sequence being at least 70%, optionally at least 80%, preferably at least 85%, more preferably at least 90% and most preferably at least 95%, homologous to a polypeptide having the sequence MDEMGQVGLVGSCMCLGVL-CWPLPKRTSPLELGASPTHVSSTLGPLPPQ (SEQ ID NO: 583) corresponding to amino acids 1-49 of HUMSP18A_P22 (SEQ ID NO:129), a second amino acid sequence being at least 90% homologous to DDLCQECEDI-VHILNKMAKEAIFQDTMRKFLEQECNVL-PLKLLMPQCNQVLDDYFPLVIDYFQNQT corresponding to amino acids 66-131 of PSPB_HUMAN (SEQ ID NO:406), which also corresponds to amino acids 50-115 of HUMSP18A_P22 (SEQ ID NO:129), and a third amino acid sequence being at least 70%, optionally at least 80%, preferably at least 85%, more preferably at least 90% and most preferably at least 95% homologous to a polypeptide having the sequence VRAASSPPACLPTQAPVPTHGEPH-TQHPSQPDTHTHTHTHTAPKPARH-KHTAPQPAGHTHTHTHNTPAGRTHT HTVPQLAGHTHTQHPIQTHTH-TQYPSQLETHTHTALHPDTYPHSTPAS-QTHTHTHTHTHTQHTHSTPAGHTHTH THPVHKG-PRKLRALQPCTRPWAPRFRCTRWACTLTHPYTLTLT-HMLTHLFILTYMLMLIHTQSRPPALKSPHSPI FAFCPPT (SEQ ID NO: 482) corresponding to amino acids 116-344 of HUMSP18A_P22 (SEQ ID NO:129), wherein said first amino acid sequence, second amino acid sequence and third amino acid sequence are contiguous and in a sequential order.

B. An isolated polypeptide encoding for a head of HUMSP18A_P22 (SEQ ID NO:129), comprising a polypeptide being at least 70%, optionally at least about 80%, preferably at least about 85%, more preferably at least about 90% and most preferably at least about 95% homologous to the sequence MDEMGQVGLVGSCMCLGVLCWPLP-KRTSPLELGASPTHVSSTLGPLPPQ (SEQ ID NO: 583) of HUMSP18A_P22 (SEQ ID NO:129).

C. An isolated polypeptide encoding for an edge portion of HUMSP18A_P22 (SEQ ID NO:129), comprising an amino acid sequence being at least 70%, optionally at least about 80%, preferably at least about 85%, more preferably at least about 90% and most preferably at least about 95% homologous to the sequence VRAASSPPACLPTQAPVPTHGEPH-TQHPSQPDTHTHTHTHTAPKPARH-KHTAPQPAGHTHTHTHNTPAGRTHT HTVPQLAGHTHTQHPIQTHTH-TQYPSQLETHTHTALHPDTYPHSTPAS-QTHTHTHTHTHTQHTHSTPAGHTHTH THPVHKG-PRKLRALQPCTRPWAPRFRCTRWACTLTHPYTLTLT-HMLTHLFILTYMLMLIHTQSRPPALKSPHSPI FAFCPPT (SEQ ID NO: 482) of HUMSP18A_P22 (SEQ ID NO:129).

The location of the variant protein was determined according to results from a number of different software programs and analyses, including analyses from SignalP and other specialized programs. The variant protein is secreted.

Variant protein HUMSP18A_P22 (SEQ ID NO:129) also has the following non-silent SNPs (Single Nucleotide Polymorphisms) as listed in Table 143, (given according to their position(s) on the amino acid sequence, with the alternative amino acid(s) listed; the presence of known SNPs in variant protein HUMSP18A_P22 (SEQ ID NO:129) sequence provides support for the deduced sequence of this variant protein according to the present invention).

TABLE 143

Amino acid mutations

| SNP position(s) on amino acid sequence | Alternative amino acid(s) |
|---|---|
| 47 | P -> H |
| 82 | Q -> R |
| 103 | Y -> F |
| 106 | L -> |
| 115 | T -> I |
| 249 | Q -> E |

The glycosylation sites of variant protein HUMSP18A_P22 (SEQ ID NO:129), as compared to the known protein Pulmonary surfactant-associated protein B precursor, are described in Table 144 (given according to their position(s) on the amino acid sequence in the first column; the second column indicates whether the glycosylation site is present in the variant protein; and the last column indicates whether the position is different on the variant protein).

TABLE 144

Glycosylation site(s)

| Position(s) on known amino acid sequence | Present in variant protein? | Position(s) on variant protein |
|---|---|---|
| 178 | Yes | 162 |
| 311 | No | |

Variant protein HUMSP18A_P22 (SEQ ID NO:129) is encoded by the following transcript(s): HUMSP18A_T46 (SEQ ID NO:126), for which the coding portion starts at position 108 and ends at position 1139. The transcript also has the following SNPs as listed in Table 145 (given according to their position on the nucleotide sequence, with the alternative nucleic acid listed; the presence of known SNPs in variant protein HUMSP18A_P22 (SEQ ID NO:129) sequence provides support for the deduced sequence of this variant protein according to the present invention).

TABLE 145

Nucleic acid SNPs

| Polymorphism | SNP position(s) on nucleotide sequence |
|---|---|
| C -> A | 247, 3906 |
| G -> A | 350, 1504, 1609, 1696 |
| A -> G | 352, 545, 1545, 1720, 2262, 2498, 2839, 3805, 3817, |
| C -> T | 389, 451, 1407, 1724, 2378, 2510, 2619, 2884, 3762, 3819 |
| A -> T | 415, 1477, 2530 |
| C-> | 423, 1359, 1379, 1432, 1446, 1673, 1926, 3013 |
| C -> G | 852, 1564, 2185, 2783, 3906 |
| T -> A | 1360, 1525, |
| G -> C | 1563, 2688 |
| T -> G | 1565, 3772, 3809 |
| T -> C | 1565, 3778 |

TABLE 145-continued

Nucleic acid SNPs

| Polymorphism | SNP position(s) on nucleotide sequence |
|---|---|
| G-> | 1609, 1669, 1821, 2780 |
| G -> A | 1749, 3688, 3798, 3875, |
| G -> T | 2173, 3898 |
| A-> | 2528 |
| A -> C | 3195 |

Variant protein HUMSP18A_P38 (SEQ ID NO:130) according to the present invention has an amino acid sequence as given at the end of the application; it is encoded by transcript(s) HUMSP18A_T14 (SEQ ID NO:114) and HUMSP18A_T30 (SEQ ID NO:120). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P38 (SEQ ID NO:130) and PSPB_HUMAN (SEQ ID NO:406):

A. An isolated chimeric polypeptide as set forth in HUMSP18A_P38 (SEQ ID NO:130), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQVL-DDYFPLVIDYFQNQTDSNGICMHLGLCK SRQPEP-EQEPGMSDPLPKPLRDPLPDPLLDKLV-LPVLPGALQARPGPHTQDLSEQQFPI-PLPYCWLCRALIKRIQA MIPKGALAVAVAQVCRVVPLVAGGICQ-CLAERYSVILLDTLLGRMLPQLVCRLVL-RCSMDDSAGP corresponding to amino acids 1-285 of PSPB_HUMAN (SEQ ID NO:406), which also corresponds to amino acids 1-285 of HUMSP18A_P38 (SEQ ID NO:130), and a second amino acid sequence being at least 70%, optionally at least 80%, preferably at least 85%, more preferably at least 90% and most preferably at least 95% homologous to a polypeptide having the sequence SEPTAPSLAQ-CLLSSSPYPATA (SEQ ID NO: 481) corresponding to amino acids 286-307 of HUMSP18A_P38 (SEQ ID NO:130), wherein said first amino acid sequence and second amino acid sequence are contiguous and in a sequential order.

B. An isolated polypeptide encoding for an edge portion of HUMSP18A_P38 (SEQ ID NO:130), comprising an amino acid sequence being at least 70%, optionally at least about 80%, preferably at least about 85%, more preferably at least about 90% and most preferably at least about 95% homologous to the sequence SEPTAPSLAQCLLSSSPYPATA (SEQ ID NO: 481) of HUMSP18A_P38 (SEQ ID NO:130).

The location of the variant protein was determined according to results from a number of different software programs and analyses, including analyses from SignalP and other specialized programs. The variant protein is secreted.

Variant protein HUMSP18A_P38 (SEQ ID NO:130) also has the following non-silent SNPs (Single Nucleotide Polymorphisms) as listed in Table 146, (given according to their position(s) on the amino acid sequence, with the alternative amino acid(s) listed; the presence of known SNPs in variant protein HUMSP18A_P38 (SEQ ID NO:130) sequence provides support for the deduced sequence of this variant protein according to the present invention).

TABLE 146

Amino acid mutations

| SNP position(s) on amino acid sequence | Alternative amino acid(s) |
|---|---|
| 4 | S -> |
| 15 | P -> L |
| 34 | Q -> |
| 60 | W -> * |
| 98 | Q -> R |
| 119 | Y -> F |
| 122 | L -> |
| 131 | T -> I |
| 160 | L -> |
| 160 | L -> Q |
| 166 | D -> |
| 176 | L -> F |
| 184 | A -> |
| 189 | P -> |
| 199 | Q -> L |
| 208 | C -> Y |
| 215 | I -> N |
| 222 | I -> V |
| 228 | A -> G |
| 228 | A -> P |
| 243 | G -> |
| 243 | G -> D |
| 263 | G -> |
| 264 | R -> |
| 272 | R -> H |
| 280 | D -> G |
| 291 | P -> H |
| 297 | L -> P |

The glycosylation sites of variant protein HUMSP18A_P38 (SEQ ID NO:130), as compared to the known protein Pulmonary surfactant-associated protein B precursor, are described in Table 147 (given according to their position(s) on the amino acid sequence in the first column; the second column indicates whether the glycosylation site is present in the variant protein; and the last column indicates whether the position is different on the variant protein).

TABLE 147

Glycosylation site(s)

| Position(s) on known amino acid sequence | Present in variant protein? | Position(s) on variant protein |
|---|---|---|
| 129 | Yes | 129 |
| 311 | No | |

Variant protein HUMSP18A_P38 (SEQ ID NO:130) is encoded by the following transcript(s): HUMSP18A_T14 (SEQ ID NO:114) and HUMSP18A_T30 (SEQ ID NO:120), coding portion starts at position 137 and ends at position 1057. The transcript also has the following SNPs as listed in Table 148 (given according to their position on the nucleotide sequence, with the alternative nucleic acid listed; the presence of known SNPs in variant protein HUMSP18A_P38 (SEQ ID NO:130) sequence provides support for the deduced sequence of this variant protein according to the present invention).

TABLE 148

Nucleic acid SNPs

| Polymorphism | SNP position(s) on nucleotide sequence |
|---|---|
| G -> A | 95, 184, 316, 427, 759, 864, 951, 1176, 3115, 3225, 3302 |
| A -> C | 105, 2622 |
| T -> | 146 |
| C -> T | 180, 208, 466, 528, 662, 979, 1805, 1937, 2046, 2311, 3189, 3246 |
| G -> | 238, 864, 924, 1248, 2207 |
| A -> G | 429, 800, 975, 1021, 1689, 1925, 2266, 3232, 3244 |
| A -> T | 492, 732, 1957 |
| C -> | 500, 614, 634, 687, 701, 928, 1353, 2440 |
| T -> A | 615, 780 |
| G -> C | 818, 2115 |
| C -> G | 819, 1612, 2210, 3333 |
| T -> G | 820, 3199, 3236 |
| T -> C | 820, 1026, 3205 |
| C -> A | 1008, 3333 |
| G -> T | 1600, 3325 |
| A -> | 1955 |

The coding portion of transcript HUMSP18A_T30 (SEQ ID NO:120) starts at position 137 and ends at position 1057. The transcript also has the following SNPs as listed in Table 149 (given according to their position on the nucleotide sequence, with the alternative nucleic acid listed; the presence of known SNPs in variant protein HUMSP18A_P38 (SEQ ID NO:130) sequence provides support for the deduced sequence of this variant protein according to the present invention).

TABLE 149

Nucleic acid SNPs

| Polymorphism | SNP position(s) on nucleotide sequence |
|---|---|
| G -> A | 95, 184, 316, 427, 759, 864, 951, 1176, 1324, 3395, 3472, |
| A -> C | 105, 2792 |
| T -> | 146 |
| C -> T | 180, 208, 466, 528, 662, 979, 1975, 2107, 2216, 2481, 3359, 3416 |
| G -> | 238, 864, 924, 1248, 2377 |
| A -> G | 429 |
| A -> T | 492 |
| C -> | 500, 614, 634, 687, 701, 928, 1523, 2610 |
| T -> A | 615, 780, |
| A -> T | 732, 2127 |
| A -> G | 800, 975, 1021, 1859, 1975, 2436, 3402, 3414 |
| G -> C | 818, 2285 |
| C -> G | 819, 1782, 2380, 3503 |
| T -> G | 820, 3369, 3406 |
| T -> C | 820, 1026, 3375 |
| C -> A | 1008, 3503 |
| | 1026 |
| G -> T | 1770, 3495 |
| A -> | 2125 |
| G -> A | 3285 |

Variant protein HUMSP18A_P39 (SEQ ID NO:131) according to the present invention has an amino acid sequence as given at the end of the application; it is encoded by transcript(s) HUMSP18A_T15 (SEQ ID NO:115) and HUMSP18A_T27 (SEQ ID NO:118). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P39 (SEQ ID NO:131) and PSPB_HUMAN (SEQ ID NO:406):

A. An isolated chimeric polypeptide as set forth in HUMSP18A_P39 (SEQ ID NO:131), comprising a first amino acid sequence being at least 90% homologous to MAESHLLQWLLLLLPTLCGPGTAAWTTSSLACAQGPEFWCQSLEQALQCRALGHCLQEVWGHVGADDLCQE CEDIVHILNKMAKEAIFQDTMRKFLEQECNVLPLKLLMPQCNQVLDDYFPLVIDYFQNQTDSNGICMHLGLCK SRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWL PRDSECHLCMSVTTQAGNSSEQAIPQAMLQACVGSWLDREK corresponding to amino acids 1-334 of PSPB_HUMAN (SEQ ID NO:406), which also corresponds to amino acids 1-334 of HUMSP18A_P39 (SEQ ID NO:131), and a second amino acid sequence being at least 70%, optionally at least 80%, preferably at least 85%, more preferably at least 90% and most preferably at least 95% homologous to a polypeptide having the sequence LAPVC (SEQ ID NO: 484) corresponding to amino acids 335-339 of HUMSP18A_P39 (SEQ ID NO:131), wherein said first amino acid sequence and second amino acid sequence are contiguous and in a sequential order.

B. An isolated polypeptide encoding for an edge portion of HUMSP18A_P39 (SEQ ID NO:131), comprising an amino acid sequence being at least 70%, optionally at least about 80%, preferably at least about 85%, more preferably at least about 90% and most preferably at least about 95% homologous to the sequence LAPVC (SEQ ID NO: 484) of HUMSP18A_P39 (SEQ ID NO:131).

The location of the variant protein was determined according to results from a number of different software programs and analyses, including analyses from SignalP and other specialized programs. The variant protein is secreted.

Variant protein HUMSP18A_P39 (SEQ ID NO:131) also has the following non-silent SNPs (Single Nucleotide Polymorphisms) as listed in Table 150, (given according to their position(s) on the amino acid sequence, with the alternative amino acid(s) listed; the presence of known SNPs in variant protein HUMSP18A_P39 (SEQ ID NO:131) sequence provides support for the deduced sequence of this variant protein according to the present invention).

TABLE 150

| Amino acid mutations | |
|---|---|
| SNP position(s) on amino acid sequence | Alternative amino acid(s) |
| 4 | S-> |
| 15 | P -> L |
| 34 | Q-> |
| 60 | W -> * |
| 98 | Q -> R |
| 119 | Y -> F |
| 122 | L-> |
| 131 | T -> I |
| 160 | L-> |
| 160 | L -> Q |
| 166 | D-> |
| 176 | L -> F |
| 184 | A-> |
| 189 | P-> |
| 199 | Q -> L |
| 208 | C -> Y |
| 215 | I -> N |
| 222 | I -> V |
| 228 | A -> G |
| 228 | A -> P |
| 243 | G-> |

TABLE 150-continued

| Amino acid mutations | |
|---|---|
| SNP position(s) on amino acid sequence | Alternative amino acid(s) |
| 243 | G -> D |
| 263 | G-> |
| 264 | R-> |
| 272 | R -> H |
| 280 | D -> G |
| 290 | G -> R |
| 314 | E-> |
| 339 | C -> Y |

The glycosylation sites of variant protein HUMSP18A_P39 (SEQ ID NO:131), as compared to the known protein Pulmonary surfactant-associated protein B precursor, are described in Table 151 (given according to their position(s) on the amino acid sequence in the first column; the second column indicates whether the glycosylation site is present in the variant protein; and the last column indicates whether the position is different on the variant protein).

TABLE 151

| Glycosylation site(s) | | |
|---|---|---|
| Postion(s) on known amino acid sequence | Present in variant protein? | Position(s) on variant protein |
| 129 | Yes | 129 |
| 311 | Yes | 311 |

Variant protein HUMSP18A_P39 (SEQ ID NO:131) is encoded by the following transcript(s): HUMSP18A_T15 (SEQ ID NO:115) and HUMSP18A_T27 (SEQ ID NO:118), for which the sequence(s) is/are given at the end of the application.

The coding portion of transcript HUMSP18A_T15 (SEQ ID NO:115) starts at position 137 and ends at position 1153. The transcript also has the following SNPs as listed in Table 152 (given according to their position on the nucleotide sequence, with the alternative nucleic acid listed; the presence of known SNPs in variant protein HUMSP18A_P39 (SEQ ID NO:131) sequence provides support for the deduced sequence of this variant protein according to the present invention).

TABLE 152

| Nucleic acid SNPs | |
|---|---|
| Polymorphism | SNP position(s) on nucleotide sequence |
| G -> A | 95, 184, 316, 427, 759, 864, 951, 1004, 1152, 3113, 3223, 3300 |
| A -> C | 105, 2620 |
| T-> | 146 |
| C -> T | 180, 208, 466, 528, 662, 979, 1803, 1935, 2044, 2309, 3187, 3244 |
| G-> | 238, 864, 924, 1076, 2205 |
| A -> G | 429 |
| A -> T | 492, 732, 1955 |
| C-> | 500, 614, 634, 687, 701, 928, 1351, 2438 |
| T -> A | 615, 780, |
| A -> G | 800, 975, 1687, 1923, 2264, 3230, 3242 |
| G -> C | 818, 2113 |
| C -> G | 819, 1610, 2208, 3331 |
| T -> G | 820, 3197, 3234 |
| T -> C | 820, 3203 |
| G -> T | 1598, 3323 |
| A-> | 1953 |
| C -> A | 3331 |

The coding portion of transcript HUMSP18A_T27 (SEQ ID NO:118) starts at position 137 and ends at position 1153. The transcript also has the following SNPs as listed in Table 153 (given according to their position on the nucleotide sequence, with the alternative nucleic acid listed; the presence of known SNPs in variant protein HUMSP18A_P39 (SEQ ID NO:131) sequence provides support for the deduced sequence of this variant protein according to the present invention).

TABLE 153

Nucleic acid SNPs

| Polymorphism | SNP position(s) on nucleotide sequence |
|---|---|
| G -> A | 95, 184, 316, 427, 759, 951, 1004, 1152, 2286, 2473, 864, 2396 |
| A -> C | 105, 1793 |
| T-> | 146 |
| C -> T | 180, 208, 466, 662, 979, 1482, 2360, 2417 |
| G-> | 238, 864, 924, 1076 |
| A -> G | 429, 800, 975, 2403, 2415 |
| A -> T | 492, 732 |
| C-> | 500, 614, 634, 687, 701, 928, 1351, 1611 |
| C -> T | 528 |
| T -> A | 615, 780 |
| G -> C | 818 |
| C -> G | 819, 2504 |
| T -> G | 820, 2370, 2407 |
| T -> C | 820, 2376 |
| G -> T | 2496 |
| C -> A | 2504 |

Variant protein HUMSP18A_P41 (SEQ ID NO:132) according to the present invention has an amino acid sequence as given at the end of the application; it is encoded by transcript(s) HUMSP18A_T20 (SEQ ID NO:116). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P41 (SEQ ID NO:132) and PSPB_HUMAN (SEQ ID NO:406):

A. An isolated chimeric polypeptide as set forth in HUMSP18A_P41 (SEQ ID NO:132), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQ-VLDDYFPLVIDYFQNQTDSNGICMHLGLCK SRQPEP-EQEPGMSDPLPKPLRDPLPDPLLDKLV-LPVLPGALQARPGPHTQDLSEQQFPI-PLPYCWLCRALIKRIQA MIPK corresponding to amino acids 1-224 of PSPB_HUMAN (SEQ ID NO:406), which also corresponds to amino acids 1-224 of HUMSP18A_P41 (SEQ ID NO:132), and a second amino acid sequence being at least 70%, optionally at least 80%, preferably at least 85%, more preferably at least 90% and most preferably at least 95% homologous to a polypeptide having the sequence VRHPG-PHRAQEHTHTCSSLQLPPLSQLTPPS-GPSWLPEVRRGESRLCIAPTQGTLGLRL-RPGRCQAYSSCNKH (SEQ ID NO: 485) corresponding to amino acids 225-297 of HUMSP18A_P41 (SEQ ID NO:132), wherein said first amino acid sequence and second amino acid sequence are contiguous and in a sequential order.

B. An isolated polypeptide encoding for an edge portion of HUMSP18A_P41 (SEQ ID NO:132), comprising an amino acid sequence being at least 70%, optionally at least about 80%, preferably at least about 85%, more preferably at least about 90% and most preferably at least about 95% homologous to the sequence VRHPGPHRAQEHTHTCSSLQLP-PLSQLTPPSGPSWLPEVRRGESRL-CIAPTQGTLGLRLRPGRCQAYSSCNKH (SEQ ID NO: 485) of HUMSP18A_P41 (SEQ ID NO:132).

The location of the variant protein was determined according to results from a number of different software programs and analyses, including analyses from SignalP and other specialized programs. The variant protein is secreted.

Variant protein HUMSP18A_P41 (SEQ ID NO:132) also has the following non-silent SNPs (Single Nucleotide Polymorphisms) as listed in Table 154, (given according to their position(s) on the amino acid sequence, with the alternative amino acid(s) listed; the presence of known SNPs in variant protein HUMSP18A_P41 (SEQ ID NO:132) sequence provides support for the deduced sequence of this variant protein according to the present invention).

TABLE 154

Amino acid mutations

| SNP position(s) on amino acid sequence | Alternative amino acid(s) |
|---|---|
| 4 | S-> |
| 15 | P -> L |
| 34 | Q-> |
| 60 | W -> * |
| 98 | Q -> R |
| 119 | Y -> F |
| 122 | L-> |
| 131 | T -> I |
| 160 | L-> |
| 160 | L -> Q |
| 166 | D-> |
| 176 | L -> F |
| 184 | A-> |
| 189 | P-> |
| 199 | Q -> L |
| 208 | C -> Y |
| 215 | I -> N |
| 222 | I -> V |

The glycosylation sites of variant protein HUMSP18A_P41 (SEQ ID NO:132), as compared to the known protein Pulmonary surfactant-associated protein B precursor, are described in Table 155 (given according to their position(s) on the amino acid sequence in the first column; the second column indicates whether the glycosylation site is present in the variant protein; and the last column indicates whether the position is different on the variant protein).

TABLE 155

Glycosylation site(s)

| Position(s) on known amino acid sequence | Present in variant protein? | Postion(s) on variant protein |
|---|---|---|
| 129 | Yes | 129 |
| 311 | No | |

Variant protein HUMSP18A_P41 (SEQ ID NO:132) is encoded by the following transcript(s): HUMSP18A_T20 (SEQ ID NO:116), for which the coding portion starts at position 137 and ends at position 1027. The transcript also has the following SNPs as listed in Table 156 (given according to their position on the nucleotide sequence, with the alternative nucleic acid listed; the presence of known SNPs in variant protein HUMSP18A_P41 (SEQ ID NO:132) sequence provides support for the deduced sequence of this variant protein according to the present invention).

TABLE 156

Nucleic acid SNPs

| Polymorphism | SNP position(s) on nucleotide sequence |
|---|---|
| G -> A | 95, 184, 316, 427, 759, 1060, 1643, 2007, 2305, 2392, 2445, 4384, 4494, 4571 |
| A -> C | 105, 3891 |
| T-> | 146 |
| C -> T | 180, 208, 466, 528, 662, 2218, 2420, 3074, 3206, 3315, 3580, 4458, 4515 |
| G-> | 238, 2305, 2365, 2517, 3476 |
| A -> G | 429, 800, 2416, 2958, 3194, 3535, 4501, 4513 |
| A -> T | 492, 732, 1334, 3226 |
| C-> | 500, 614, 634, 687, 701, 2369, 2622, 3709 |
| T -> A | 615, 780 |
| A-> | 1841, 3224 |
| G -> C | 1956, 2259, 3384 |
| T -> C | 2066, 2261, 4474 |
| C -> G | 2260, 2882, 3479, 4602 |
| T -> G | 2261, 4468, 4505 |
| G -> T | 2869, 4594 |
| C -> A | 4602 |

Variant protein HUMSP18A_P43 (SEQ ID NO:133) according to the present invention has an amino acid sequence as given at the end of the application; it is encoded by transcript(s) HUMSP18A_T23 (SEQ ID NO:117). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P43 (SEQ ID NO:133) and PSPB_HUMAN (SEQ ID NO:406):

A. An isolated chimeric polypeptide as set forth in HUMSP18A_P43 (SEQ ID NO:133), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQV-LDDYFPLVIDYFQNQT corresponding to amino acids 1-131 of PSPB_HUMAN (SEQ ID NO:406), which also corresponds to amino acids 1-131 of HUMSP18A_P43 (SEQ ID NO:133), and a second amino acid sequence being at least 70%, optionally at least 80%, preferably at least 85%, more preferably at least 90% and most preferably at least 95% homologous to a polypeptide having the sequence VRAASSPPACLPTQAPVPTHGEPH-TQHPSQPDTHTHTHTHTAPKPARH-KHTAPQPAGHTHTHTHNTPAGRTHT HTVPQLAGHTHTQHPIQTHTH-TQYPSQLETHTHTALHPDTYPHSTPAS-QTHTHTHTHTHTQHTHSTPAGHTHTH THPVHKG-PRKLRALQPCTRPWAPRFRCTRWACTLTHPYTLTLT-HMLTHLFILTYMLMLIHTQSRPPALKSPHSPI FAFCPPT (SEQ ID NO: 482) corresponding to amino acids 132-360 of HUMSP18A_P43 (SEQ ID NO:133), wherein said first amino acid sequence and second amino acid sequence are contiguous and in a sequential order.

B. An isolated polypeptide encoding for an edge portion of HUMSP18A_P43 (SEQ ID NO:133), comprising an amino acid sequence being at least 70%, optionally at least about 80%, preferably at least about 85%, more preferably at least about 90% and most preferably at least about 95% homologous to the sequence VRAASSPPACLPTQAPVPTHGEPH-TQHPSQPDTHTHTHTHTAPKPARH-KHTAPQPAGHTHTHTHNTPAGRTHT HTVPQLAGHTHTQHPIQTHTH-TQYPSQLETHTHTALHPDTYPHSTPAS-QTHTHTHTHTHTQHTHSTPAGHTHTH THPVHKG-PRKLRALQPCTRPWAPRFRCTRWACTLTHPYTLTLT-HMLTHLFILTYMLMLIHTQSRPPALKSPHSPI FAFCPPT (SEQ ID NO: 482) of HUMSP18A_P43 (SEQ ID NO:133).

The location of the variant protein was determined according to results from a number of different software programs and analyses, including analyses from SignalP and other specialized programs. The variant protein is secreted.

Variant protein HUMSP18A_P43 (SEQ ID NO:133) also has the following non-silent SNPs (Single Nucleotide Polymorphisms) as listed in Table 157, (given according to their position(s) on the amino acid sequence, with the alternative amino acid(s) listed; the presence of known SNPs in variant protein HUMSP18A_P43 (SEQ ID NO:133) sequence provides support for the deduced sequence of this variant protein according to the present invention).

TABLE 157

Amino acid mutations

| SNP position(s) on amino acid sequence | Alternative amino acid(s) |
|---|---|
| 4 | S -> |
| 15 | P -> L |
| 34 | Q -> |
| 60 | W -> * |
| 98 | Q -> R |
| 119 | Y -> F |
| 122 | L -> |
| 131 | T -> I |
| 265 | Q -> E |

The glycosylation sites of variant protein HUMSP18A_P43 (SEQ ID NO:133), as compared to the known protein Pulmonary surfactant-associated protein B precursor, are described in Table 158 (given according to their position(s) on the amino acid sequence in the first column; the second column indicates whether the glycosylation site is present in the variant protein; and the last column indicates whether the position is different on the variant protein).

TABLE 158

Glycosylation site(s)

| Position(s) on known amino acid sequence | Present in variant protein? | Position(s) on variant protein |
|---|---|---|
| 129 | Yes | 129 |
| 311 | No | |

Variant protein HUMSP18A_P43 (SEQ ID NO:133) is encoded by the following transcript(s): HUMSP18A_T23 (SEQ ID NO:117), for which the coding portion starts at position 137 and ends at position 1216. The transcript also has the following SNPs as listed in Table 159 (given according to their position on the nucleotide sequence, with the alternative nucleic acid listed; the presence of known SNPs in variant protein HUMSP18A_P43 (SEQ ID NO:133) sequence provides support for the deduced sequence of this variant protein according to the present invention).

TABLE 159

Nucleic acid SNPs

| Polymorphism | SNP position(s) on nucleotide sequence |
| --- | --- |
| G -> A | 95, 184, 316, 427, 1581, 1686, 1773, 1826, 3765, 3875, 3952 |
| A -> C | 105, 3272 |
| T -> | 146 |
| C -> T | 180, 208, 528, 1484, 1801, 2455, 2587, 2696, 2961, 3839, 3896 |
| G -> | 238, 1686, 1746, 1898, 2857 |
| A -> G | 429, 622, 1622, 1797, 2339, 2575, 2916, 3882, 3894 |
| C -> T | 466 |
| A -> T | 492, 1554, 2607 |
| C -> | 500, 1436, 1456, 1509, 1523, 1750, 2003, 3090 |
| C -> G | 929, 1641, 2262, 2860, 3983 |
| T -> A | 1437, 1602 |
| G -> C | 1640, 2765 |
| T -> G | 1642, 3849, 3886 |
| T -> C | 1642, 3855 |
| G -> T | 2250, 3975 |
| A -> | 2605 |
| C -> A | 3983 |

Variant protein HUMSP18A_P45 (SEQ ID NO:134) according to the present invention has an amino acid sequence as given at the end of the application; it is encoded by transcript(s) HUMSP18A_T29 (SEQ ID NO:119). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P45 (SEQ ID NO:134) and PSPB_HUMAN (SEQ ID NO:406):

A. An isolated chimeric polypeptide as set forth in HUMSP18A_P45 (SEQ ID NO:134), comprising a first amino acid sequence being at least 90% homologous to MAESHLLQWLLLLLPTLCGPGTAAW-TTSSLACAQGPEFWCQSLEQALQCRAL-GHCLQEVWGHVGA corresponding to amino acids 1-65 of PSPB_HUMAN (SEQ ID NO:406), which also corresponds to amino acids 1-65 of HUMSP18A_P45 (SEQ ID NO:134), a second amino acid sequence being at least 70%, optionally at least 80%, preferably at least 85%, more preferably at least 90% and most preferably at least 95% homologous to a polypeptide having the sequence RTSPLELGASPTH-VSSTLGPLPPQ (SEQ ID NO: 487) corresponding to amino acids 66-89 of HUMSP18A_P45 (SEQ ID NO:134), and a third amino acid sequence being at least 90% homologous to DDLCQECEDIVHILNKMAKEAIFQDTM-RKFLEQECNVLPLKLLMPQCNQVLDDYF-PLVIDYFQNQTDSNGICM HLGLCKSRQPEP-EQEPGMSDPLPKPLRDPLPDPLLDKLVLPVLPGALQ-ARPGPHTQDLSEQQFPIPLPYCWLCRA LIKRIQAMIP-KGALAVAVAQVCRVVPLVAGGICQ-CLAERYSVILLDTLLGRMLPQLVCRLVL-RCSMDDSAGPRS PTGEWLPRDSECHLCMSVTTQAGNSSE-QAIPQAMLQACVGSWLDREKCK-QFVEQHTPQLLTLVPRGWDAHTT CQALGVCGTMSS-PLQCIHSPDL corresponding to amino acids 66-381 of PSPB_HUMAN (SEQ ID NO:406), which also corresponds to amino acids 90-405 of HUMSP18A_P45 (SEQ ID NO:134), wherein said first amino acid sequence, second amino acid sequence and third amino acid sequence are contiguous and in a sequential order.

B. An isolated polypeptide encoding for an edge portion of HUMSP18A_P45 (SEQ ID NO:134), comprising an amino acid sequence being at least 70%, optionally at least about 80%, preferably at least about 85%, more preferably at least about 90% and most preferably at least about 95% homologous to the sequence RTSPLELGASPTHVSSTLGPLPPQ (SEQ ID NO: 487) of HUMSP18A_P45 (SEQ ID NO:134).

The location of the variant protein was determined according to results from a number of different software programs and analyses, including analyses from SignalP and other specialized programs. The variant protein is secreted.

Variant protein HUMSP18A_P45 (SEQ ID NO:134) also has the following non-silent SNPs (Single Nucleotide Polymorphisms) as listed in Table 160, (given according to their position(s) on the amino acid sequence, with the alternative amino acid(s) listed; the presence of known SNPs in variant protein HUMSP18A_P45 (SEQ ID NO:134) sequence provides support for the deduced sequence of this variant protein according to the present invention).

TABLE 160

Amino acid mutations

| SNP position(s) on amino acid sequence | Alternative amino acid(s) |
| --- | --- |
| 4 | S -> |
| 15 | P -> L |
| 34 | Q -> |
| 60 | W -> * |
| 87 | P -> H |
| 122 | Q -> R |
| 143 | Y -> F |
| 146 | L -> |
| 155 | T -> I |
| 184 | L -> |
| 184 | L -> Q |
| 190 | D -> |
| 200 | L -> F |
| 208 | A -> |
| 213 | P -> |
| 223 | Q -> L |
| 232 | C -> Y |
| 239 | I -> N |
| 246 | I -> V |
| 252 | A -> G |
| 252 | A -> P |
| 267 | G -> |
| 267 | G -> D |
| 287 | G -> |
| 288 | R -> |
| 296 | R -> H |
| 304 | D -> G |
| 314 | G -> R |
| 338 | E -> |
| 373 | L -> |

The glycosylation sites of variant protein HUMSP18A_P45 (SEQ ID NO:134), as compared to the known protein Pulmonary surfactant-associated protein B precursor, are described in Table 161 (given according to their position(s) on the amino acid sequence in the first column; the second column indicates whether the glycosylation site is present in the variant protein; and the last column indicates whether the position is different on the variant protein).

TABLE 161

Glycosylation site(s)

| Position(s) on known amino acid sequence | Present in variant protein? | Position(s) on variant protein |
| --- | --- | --- |
| 153 | Yes | 153 |
| 335 | Yes | 335 |

Variant protein HUMSP18A_P45 (SEQ ID NO:134) is encoded by the following transcript(s): HUMSP18A_T29 (SEQ ID NO:119), for which the coding portion starts at position 137 and ends at position 1351. The transcript also has the following SNPs as listed in Table 162 (given according to their position on the nucleotide sequence, with the alternative nucleic acid listed; the presence of known SNPs in variant protein HUMSP18A_P45 (SEQ ID NO:134) sequence provides support for the deduced sequence of this variant protein according to the present invention).

TABLE 162

Nucleic acid SNPs

| Polymorphism | SNP position(s) on nucleotide sequence |
| --- | --- |
| G -> A | 95, 184, 316, 499, 831, 936, 1023, 1076, 3015, 3125, 3202 |
| A -> C | 105, 2522 |
| T -> | 146 |
| C -> T | 180, 208, 538, 600, 734, 1051, 1705, 1837, 1946, 2211, 3089, 3146 |
| G -> | 238, 936, 996, 1148, 2107 |
| C -> A | 396, 3233 |
| A -> G | 501, 872, 1047, 1589, 1825, 2166, 3132, 3144 |
| A -> T | 564, 804, 1857 |
| C -> | 572, 686, 759, 706, 773, 1000, 2340, 1253 |
| T -> A | 687, 852 |
| G -> C | 890, 2015 |
| C -> G | 891, 1512, 2110, 3233 |
| T -> G | 892, 3099, 3136 |
| T -> C | 892, 3105 |
| G -> T | 1500, 3225 |
| A -> | 1855 |

Variant protein HUMSP18A_P48 (SEQ ID NO:135) according to the present invention has an amino acid sequence as given at the end of the application; it is encoded by transcript(s) HUMSP18A_T34 (SEQ ID NO:121). An alignment is given to the known protein (Pulmonary surfactant-associated protein B precursor) in the alignment table on the attached CD-ROM. A brief description of the relationship of the variant protein according to the present invention to each such aligned protein is as follows:
1. Comparison report between HUMSP18A_P48 (SEQ ID NO:135) and PSPB_HUMAN (SEQ ID NO:406):
  A. An isolated chimeric polypeptide as set forth in HUMSP18A_P48 (SEQ ID NO:135), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQV-LDDYFPLVIDYFQNQTDSNGICMHLGLCK SRQPEP-EQEPGMSDPLPKPLRDPLPDPLLDKLV-LPVLPGALQARPGPHTQDLSEQQFPI-PLPYCWLCRALIKRIQA MIPKG corresponding to amino acids 1-225 of PSPB_HUMAN (SEQ ID NO:406), which also corresponds to amino acids 1-225 of HUMSP18A_P48 (SEQ ID NO:135), and a second amino acid sequence being at least 70%, optionally at least 80%, preferably at least 85%, more preferably at least 90% and most preferably at least 95% homologous to a polypeptide having the sequence RRQENG-CRETLSATSACP (SEQ ID NO: 488) corresponding to amino acids 226-243 of HUMSP18A_P48 (SEQ ID NO:135), wherein said first amino acid sequence and second amino acid sequence are contiguous and in a sequential order.
  B. An isolated polypeptide encoding for an edge portion of HUMSP18A_P48 (SEQ ID NO:135), comprising an amino acid sequence being at least 70%, optionally at least about 80%, preferably at least about 85%, more preferably at least about 90% and most preferably at least about 95% homologous to the sequence RRQENGCRETLSATSACP (SEQ ID NO: 488) of HUMSP18A_P48 (SEQ ID NO:135).

The location of the variant protein was determined according to results from a number of different software programs and analyses, including analyses from SignalP and other specialized programs. The variant protein is secreted.

Variant protein HUMSP18A_P48 (SEQ ID NO:135) also has the following non-silent SNPs (Single Nucleotide Polymorphisms) as listed in Table 163, (given according to their position(s) on the amino acid sequence, with the alternative amino acid(s) listed; the presence of known SNPs in variant protein HUMSP18A_P48 (SEQ ID NO:135) sequence provides support for the deduced sequence of this variant protein according to the present invention).

TABLE 163

Amino acid mutations

| SNP position(s) on amino acid sequence | Alternative amino acid(s) |
| --- | --- |
| 4 | S -> |
| 15 | P -> L |
| 34 | Q -> |
| 60 | W -> * |
| 98 | Q -> R |
| 119 | Y -> F |
| 122 | L -> |
| 131 | T -> I |
| 160 | L -> |
| 160 | L -> Q |
| 166 | D -> |
| 176 | L -> F |
| 184 | A -> |
| 189 | P -> |
| 199 | Q -> L |
| 208 | C -> Y |
| 215 | I -> N |
| 222 | I -> V |

The glycosylation sites of variant protein HUMSP18A_P48 (SEQ ID NO:135), as compared to the known protein Pulmonary surfactant-associated protein B precursor, are described in Table 164 (given according to their position(s) on the amino acid sequence in the first column; the second column indicates whether the glycosylation site is present in the variant protein; and the last column indicates whether the position is different on the variant protein).

TABLE 164

Glycosylation site(s)

| Position(s) on known amino acid sequence | Present in variant protein? | Position(s) on variant protein |
| --- | --- | --- |
| 129 | Yes | 129 |
| 311 | No | |

Variant protein HUMSP18A_P48 (SEQ ID NO:135) is encoded by the following transcript(s): HUMSP18A_T34 (SEQ ID NO:121), for which the coding portion starts at position 137 and ends at position 865. The transcript also has the following SNPs as listed in Table 165 (given according to their position on the nucleotide sequence, with the alternative nucleic acid listed; the presence of known SNPs in variant protein HUMSP18A_P48 (SEQ ID NO:135) sequence provides support for the deduced sequence of this variant protein according to the present invention).

TABLE 165

Nucleic acid SNPs

| Polymorphism | SNP position(s) on nucleotide sequence |
| --- | --- |
| G -> A | 95, 184, 316, 427, 759, 820, 2869, 2946 |
| A -> C | 105, 2266 |
| T -> | 146 |
| C -> T | 180, 208, 466, 528, 662, 1449, 1581, 1690, 1955, 2833, 2890 |
| G -> | 238, 892, 1851 |
| A -> G | 429, 800, 1333, 1569, 1910, 2876, 2888 |
| A -> T | 492, 732, 1601 |
| C -> | 500, 614, 634, 687, 701, 997, 2084 |
| T -> A | 615, 780 |
| G -> T | 1244, 2969 |
| C -> G | 1256, 1854, 2977 |
| A -> | 1599 |
| G -> C | 1759 |
| G -> A | 2759 |
| T -> G | 2843, 2880 |
| T -> C | 2849 |
| C -> A | 2977 |

Variant protein HUMSP18A_P49 (SEQ ID NO:136) according to the present invention has an amino acid sequence as given at the end of the application; it is encoded by transcript(s) HUMSP18A_T35 (SEQ ID NO:122). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P49 (SEQ ID NO:136) and PSPB_HUMAN (SEQ ID NO:406):

A. An isolated chimeric polypeptide as set forth in HUMSP18A_P49 (SEQ ID NO:136), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQV-LDDYFPLVIDYFQNQTDSNGICMHLGLCK SRQPEP-EQEPGMSDPLPKPLRDPLPDPLLDKLV-LPVLPGALQARPGPHTQDLSEQQFPI-PLPYCWLCRALIKRIQA MIPKGALAVAVAQVCRVVPLVAGGICQ-CLAERYSVILLDTLLGRMLPQLVCRLVL-RCSMDDSAGPRSPTGEWL PRDSECHLCMSVT-TQAGNSSEQAIPQAMLQACVGSWLDREKCKQFVE-QHTPQLLTLVPRGWDAHTTCQ corresponding to amino acids 1-361 of PSPB_HUMAN (SEQ ID NO:406), which also corresponds to amino acids 1-361 of HUMSP18A_P49 (SEQ ID NO:136), and a second amino acid sequence being at least 70%, optionally at least 80%, preferably at least 85%, more preferably at least 90% and most preferably at least 95% homologous to a polypeptide having the sequence KKTPSFKVLQYGQTWWLTPAIPAP (SEQ ID NO: 489) corresponding to amino acids 362-385 of HUMSP18A_P49 (SEQ ID NO:136), wherein said first amino acid sequence and second amino acid sequence are contiguous and in a sequential order.

B. An isolated polypeptide encoding for an edge portion of HUMSP18A_P49 (SEQ ID NO:136), comprising an amino acid sequence being at least 70%, optionally at least about 80%, preferably at least about 85%, more preferably at least about 90% and most preferably at least about 95% homologous to the sequence KKTPSFKVLQYGQTWWLTPAIPAP (SEQ ID NO: 489) of HUMSP18A_P49 (SEQ ID NO:136).

The location of the variant protein was determined according to results from a number of different software programs and analyses, including analyses from SignalP and other specialized programs. The variant protein is secreted.

Variant protein HUMSP18A_P49 (SEQ ID NO:136) also has the following non-silent SNPs (Single Nucleotide Polymorphisms) as listed in Table 166, (given according to their position(s) on the amino acid sequence, with the alternative amino acid(s) listed; the presence of known SNPs in variant protein HUMSP18A_P49 (SEQ ID NO:136) sequence provides support for the deduced sequence of this variant protein according to the present invention).

TABLE 166

Amino acid mutations

| SNP position(s) on amino acid sequence | Alternative amino acid(s) |
| --- | --- |
| 4 | S -> |
| 15 | P -> L |
| 34 | Q -> |
| 60 | W -> * |
| 98 | Q -> R |
| 119 | Y -> F |
| 122 | L -> |
| 131 | T -> I |
| 160 | L -> |
| 160 | L -> Q |
| 166 | D -> |
| 176 | L -> F |
| 184 | A -> |
| 189 | P -> |
| 199 | Q -> L |
| 208 | C -> Y |
| 215 | I -> N |
| 222 | I -> V |
| 228 | A -> G |
| 228 | A -> P |
| 243 | G -> |
| 243 | G -> D |
| 263 | G -> |
| 264 | R -> |
| 272 | R -> H |
| 280 | D -> G |
| 290 | G -> R |
| 314 | E -> |
| 349 | L -> |
| 365 | P -> L |

The glycosylation sites of variant protein HUMSP18A_P49 (SEQ ID NO:136), as compared to the known protein Pulmonary surfactant-associated protein B precursor, are described in Table 167 (given according to their position(s) on the amino acid sequence in the first column; the second column indicates whether the glycosylation site is present in the variant protein; and the last column indicates whether the position is different on the variant protein).

TABLE 167

Glycosylation site(s)

| Position(s) on known amino acid sequence | Present in variant protein? | Position(s) on variant protein |
| --- | --- | --- |
| 129 | Yes | 129 |
| 311 | Yes | 311 |

Variant protein HUMSP18A_P49 (SEQ ID NO:136) is encoded by the following transcript(s): HUMSP18A_T35 (SEQ ID NO:122), for which the coding portion starts at position 137 and ends at position 1291. The transcript also has the following SNPs as listed in Table 168 (given according to their position on the nucleotide sequence, with the alternative nucleic acid listed; the presence of known SNPs in variant protein HUMSP18A_P49 (SEQ ID NO:136) sequence provides support for the deduced sequence of this variant protein according to the present invention).

TABLE 168

Nucleic acid SNPs

| Polymorphism | SNP position(s) on nucleotide sequence |
|---|---|
| G -> A | 95, 184, 316, 427, 759, 864, 951, 1004, 2034, 2144, 2221 |
| A -> C | 105 |
| T -> | 146 |
| C -> T | 180, 208, 466, 528, 662 |
| G -> | 238, 864, 924, 1076 |
| A -> G | 429, 800, 975, 2151, 2163 |
| A -> T | 492, 732 |
| C -> | 500, 614, 634, 687, 701, 928, 1181, 1359 |
| T -> A | 615, 780, |
| G -> C | 818 |
| C -> G | 819, 2252 |
| T -> G | 820, 2118, 2155 |
| T -> C | 820, 2124 |
| C -> T | 979, 1230, 2108, 2165 |
| A -> C | 1541 |
| G -> T | 2244 |
| C -> A | 2252 |

Variant protein HUMSP18A_P50 (SEQ ID NO:137) according to the present invention has an amino acid sequence as given at the end of the application; it is encoded by transcript(s) HUMSP18A_T38 (SEQ ID NO:123). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P50 (SEQ ID NO:137) and PSPB_HUMAN (SEQ ID NO:406):

A. An isolated chimeric polypeptide as set forth in HUMSP18A_P50 (SEQ ID NO:137), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQDTMRKFLEQECNVLPLKLLMPQCNQV-LDDYFPLVIDYFQNQTDSNGICMHLGLCK SRQPEP-EQEPGMSDPLPKPLRDPLPDPLLDKLV-LPVLPGALQARPGPHTQ corresponding to amino acids 1-194 of PSPB_HUMAN (SEQ ID NO:406), which also corresponds to amino acids 1-194 of HUMSP18A_P50 (SEQ ID NO:137), and a second amino acid sequence being at least 90% homologous to GALAVAVAQVCRVVPLVAGGICQ-CLAERYSVILLDTLLGRMLPQLVCRLVL-RCSMDDSAGPRSPTGEWLPRDS ECHLCMSVT-TQAGNSSEQAIPQAMLQACVGSWLDREKCKQFVEQ-HTPQLLTLVPRGWDAHTTCQALGVCGT MSS-PLQCIHSPDL corresponding to amino acids 225-381 of PSPB_HUMAN (SEQ ID NO:406), which also corresponds to amino acids 195-351 of HUMSP18A_P50 (SEQ ID NO:137), wherein said first amino acid sequence and second amino acid sequence are contiguous and in a sequential order.

B. An isolated chimeric polypeptide encoding for an edge portion of HUMSP18A_P50 (SEQ ID NO:137), comprising a polypeptide having a length "n", wherein n is at least about 10 amino acids in length, optionally at least about 20 amino acids in length, preferably at least about 30 amino acids in length, more preferably at least about 40 amino acids in length, and most preferably at least about 50 amino acids in length, wherein at least two amino acids comprise QG, having a structure as follows: a sequence starting from any of amino acid numbers 194−x to 194; and ending at any of amino acid numbers 195+((n−2)−x), in which x varies from 0 to n−2.

The location of the variant protein was determined according to results from a number of different software programs and analyses, including analyses from SignalP and other specialized programs. The variant protein is secreted.

Variant protein HUMSP18A_P50 (SEQ ID NO:137) also has the following non-silent SNPs (Single Nucleotide Polymorphisms) as listed in Table 169, (given according to their position(s) on the amino acid sequence, with the alternative amino acid(s) listed; the presence of known SNPs in variant protein HUMSP18A_P50 (SEQ ID NO:137) sequence provides support for the deduced sequence of this variant protein according to the present invention).

TABLE 169

Amino acid mutations

| SNP position(s) on amino acid sequence | Alternative amino acid(s) |
|---|---|
| 4 | S -> |
| 15 | P -> L |
| 34 | Q -> |
| 60 | W -> * |
| 98 | Q -> R |
| 119 | Y -> F |
| 122 | L -> |
| 131 | T -> I |
| 160 | L -> |
| 160 | L -> Q |
| 166 | D -> |
| 176 | L -> F |
| 184 | A -> |
| 189 | P -> |
| 198 | A -> G |
| 198 | A -> P |
| 213 | G -> |
| 213 | G -> D |
| 233 | G -> |
| 234 | R -> |
| 242 | R -> H |
| 250 | D -> G |
| 260 | G -> R |
| 284 | E -> |
| 319 | L -> |

The glycosylation sites of variant protein HUMSP18A_P50 (SEQ ID NO:137), as compared to the known protein Pulmonary surfactant-associated protein B precursor, are described in Table 170 (given according to their position(s) on the amino acid sequence in the first column; the second column indicates whether the glycosylation site is present in the variant protein; and the last column indicates whether the position is different on the variant protein).

TABLE 170

Glycosylation site(s)

| Position(s) on known amino acid sequence | Present in variant protein? | Position(s) on variant protein |
|---|---|---|
| 129 | Yes | 129 |
| 281 | Yes | 281 |

Variant protein HUMSP18A_P50 (SEQ ID NO:137) is encoded by the following transcript(s): HUMSP18A_T38 (SEQ ID NO:123), for which the coding portion starts at position 137 and ends at position 1189. The transcript also has the following SNPs as listed in Table 171 (given according to their position on the nucleotide sequence, with the alternative nucleic acid listed; the presence of known SNPs in variant protein HUMSP18A_P50 (SEQ ID NO:137) sequence provides support for the deduced sequence of this variant protein according to the present invention).

TABLE 171

Nucleic acid SNPs

| Polymorphism | SNP position(s) on nucleotide sequence |
|---|---|
| G -> A | 95, 184, 316, 427, 774, 861, 914, 2853, 2963, 3040 |
| A -> C | 105, 2360 |
| T -> | 146 |
| C -> T | 180, 466, 528, 662, 889, 1675, 2927, 2984, 1784, 208, 1543 |
| G -> | 238, 774, 986, 834, 1945 |
| A -> G | 429, 1427, 885, 1663, 2004, 2970, 2982 |
| A -> T | 492, 1695 |
| C -> | 500, 614, 687, 634, 701, 838, 1091, 2178 |
| T -> A | 615 |
| G -> C | 728, 1853 |
| C -> G | 729, 1350, 1948, 3071 |
| T -> G | 730, 2937, 2974 |
| T -> C | 730, 2943 |
| G -> T | 1338, 3063 |
| A -> | 1693 |
| C -> T | 2049 |
| C -> A | 3071 |

Variant protein HUMSP18A_P53 (SEQ ID NO:138) according to the present invention has an amino acid sequence as given at the end of the application; it is encoded by transcript(s) HUMSP18A_T42 (SEQ ID NO:124). An alignment is given to the known protein (Pulmonary surfactant-associated protein B precursor) in the alignment table on the attached CD-ROM. A brief description of the relationship of the variant protein according to the present invention to each such aligned protein is as follows:

1. Comparison report between HUMSP18A_P53 (SEQ ID NO:138) and PSPB_HUMAN (SEQ ID NO:406):

A. An isolated chimeric polypeptide as set forth in HUMSP18A_P53 (SEQ ID NO:138), comprising a first amino acid sequence being at least 90% homologous to MAESHLLQWLLLLLPTLCGPGTAAW-TTSSLACAQGPEFWCQSLEQALQCRAL-GHCLQEVWGHVGADDLCQE CEDIVHILNK-MAKEAIFQ corresponding to amino acids 1-89 of PSPB_HUMAN (SEQ ID NO:406), which also corresponds to amino acids 1-89 of HUMSP18A_P53 (SEQ ID NO:138), and a second amino acid sequence being at least 90% homologous to DSNGICMHLGLCKSRQPEPEQEPGMSD-PLPKPLRDPLPDPLLDKLVLPVLP-GALQARPGPHTQDLSEQQFPIPLP YCWLCRALIKRIQAMIPKGALAVAVA-QVCRVVPLVAGGICQCLAERYS-VILLDTLLGRMLPQLVCRLVLRCSM DDSAGPRSPT-GEWLPRDSECHLCMSVTTQAGNSSEQAIPQAMLQA-CVGSWLDREKCKQFVEQHTPQLLTLVPR GWDAHT-TCQALGVCGTMSSPLQCIHSPDL corresponding to amino acids 132-381 of PSPB_HUMAN (SEQ ID NO:406), which also corresponds to amino acids 90-339 of HUMSP18A_P53 (SEQ ID NO:138), wherein said first amino acid sequence and second amino acid sequence are contiguous and in a sequential order.

B. An isolated chimeric polypeptide encoding for an edge portion of HUMSP18A_P53 (SEQ ID NO:138), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QD, having a structure as follows: a sequence starting from any of amino acid numbers 89-x to 89; and ending at any of amino acid numbers 90+((n-2)-x), in which x varies from 0 to n-2.

The location of the variant protein was determined according to results from a number of different software programs and analyses, including analyses from SignalP and other specialized programs. The variant protein is secreted.

Variant protein HUMSP18A_P53 (SEQ ID NO:138) also has the following non-silent SNPs (Single Nucleotide Polymorphisms) as listed in Table 172, (given according to their position(s) on the amino acid sequence, with the alternative amino acid(s) listed; the presence of known SNPs in variant protein HUMSP18A_P53 (SEQ ID NO:138) sequence provides support for the deduced sequence of this variant protein according to the present invention).

TABLE 172

Amino acid mutations

| SNP position(s) on amino acid sequence | Alternative amino acid(s) |
|---|---|
| 4 | S -> |
| 15 | P -> L |
| 34 | Q -> |
| 60 | W -> * |
| 118 | L -> |
| 118 | L -> Q |
| 124 | D -> |
| 134 | L -> F |
| 142 | A -> |
| 147 | P -> |
| 157 | Q -> L |
| 166 | C -> Y |
| 173 | I -> N |
| 180 | I -> V |
| 186 | A -> G |
| 186 | A -> P |
| 201 | G -> |
| 201 | G -> D |
| 221 | G -> |
| 222 | R -> |
| 230 | R -> H |
| 238 | D -> G |
| 248 | G -> R |
| 272 | E -> |
| 307 | L -> |

The glycosylation sites of variant protein HUMSP18A_P53 (SEQ ID NO:138), as compared to the known protein Pulmonary surfactant-associated protein B precursor, are described in Table 173 (given according to their position(s) on the amino acid sequence in the first column; the second column indicates whether the glycosylation site is present in the variant protein; and the last column indicates whether the position is different on the variant protein).

TABLE 173

Glycosylation site(s)

| Position(s) on known amino acid sequence | Present in variant protein? | Position(s) on variant protein |
|---|---|---|
| 129 | No | |
| 269 | Yes | 269 |

Variant protein HUMSP18A_P53 (SEQ ID NO:138) is encoded by the following transcript(s): HUMSP18A_T42 (SEQ ID NO:124), for which the coding portion starts at position 137 and ends at position 1153. The transcript also has the following SNPs as listed in Table 174 (given according to their position on the nucleotide sequence, with the alternative nucleic acid listed; the presence of known SNPs in variant protein HUMSP18A_P53 (SEQ ID NO:138) sequence provides support for the deduced sequence of this variant protein according to the present invention).

TABLE 174

Nucleic acid SNPs

| Polymorphism | SNP position(s) on nucleotide sequence |
|---|---|
| G -> A | 95, 184, 633, 316, 738, 878, 2927, 2817, 825, 3004 |
| A -> C | 105, 2324 |
| T -> | 146 |
| C -> T | 180, 208, 536, 853, 1748, 1507, 2013, 2891, 2948, 1639 |
| G -> | 238, 738, 1909, 950, 798 |
| C -> | 488, 561, 508, 575, 802, 1055, 2142 |
| T -> A | 489, 654 |
| A -> T | 606, 1659 |
| A -> G | 674, 849, 1391, 1627, 1968, 2934, 2946 |
| G -> C | 692, 1817 |
| C -> G | 693, 1314, 1912, 3035 |
| T -> G | 694, 2901, 2938 |
| T -> C | 694, 2907 |
| G -> T | 1302, 3027 |
| A -> | 1657 |
| C -> A | 3035 |

As noted above, cluster HUMSP18A features 50 segment(s), which were listed in Table 132 above and for which the sequence(s) are given. These segment(s) are portions of nucleic acid sequence(s) which are described herein separately because they are of particular interest. A description of segments 32, 34, and 38 according to the present invention is now provided.

Segment cluster HUMSP18A N32 (SEQ ID NO:164) according to the present invention is supported by 16 libraries. The number of libraries was determined as previously described. This segment can be found in the following transcript(s): HUMSP18A_T14 (SEQ ID NO:114) and HUMSP18A_T30 (SEQ ID NO:120). Table 175 below describes the starting and ending position of this segment on each transcript.

TABLE 175

Segment location on transcripts

| Transcript name | Segment starting position | Segment ending position |
|---|---|---|
| HUMSP18A_T14 (SEQ ID NO: 114) | 993 | 1164 |
| HUMSP18A_T30 (SEQ ID NO: 120) | 993 | 1164 |

According to an optional embodiment of the present invention, short segments related to the above cluster are also provided. These segments are up to about 120 bp in length, and so are included in a separate description.

Segment cluster HUMSP18A N34 (SEQ ID NO:166) according to the present invention is supported by 89 libraries. The number of libraries was determined as previously described. This segment can be found in the following transcript(s): HUMSP18A_T14 (SEQ ID NO:114), HUMSP18A_T15 (SEQ ID NO:115), HUMSP18A_T20 (SEQ ID NO:116), HUMSP18A_T23 (SEQ ID NO:117), HUMSP18A_T27 (SEQ ID NO:118), HUMSP18A_T29 (SEQ ID NO:119), HUMSP18A_T30 (SEQ ID NO:120), HUMSP18A_T34 (SEQ ID NO:121), HUMSP18A_T35 (SEQ ID NO:122), HUMSP18A_T38 (SEQ ID NO:123), HUMSP18A_T42 (SEQ ID NO:124), HUMSP18A_T44 (SEQ ID NO:125) and HUMSP18A_T46 (SEQ ID NO:126). Table 176 below describes the starting and ending position of this segment on each transcript.

TABLE 176

Segment location on transcripts

| Transcript name | Segment starting position | Segment ending position |
|---|---|---|
| HUMSP18A_T14 (SEQ ID NO: 114) | 1177 | 1208 |
| HUMSP18A_T15 (SEQ ID NO: 115) | 1005 | 1036 |
| HUMSP18A_T20 (SEQ ID NO: 116) | 2446 | 2477 |
| HUMSP18A_T23 (SEQ ID NO: 117) | 1827 | 1858 |
| HUMSP18A_T27 (SEQ ID NO: 118) | 1005 | 1036 |
| HUMSP18A_T29 (SEQ ID NO: 119) | 1077 | 1108 |
| HUMSP18A_T30 (SEQ ID NO: 120) | 1177 | 1208 |
| HUMSP18A_T34 (SEQ ID NO: 121) | 821 | 852 |
| HUMSP18A_T35 (SEQ ID NO: 122) | 1005 | 1036 |
| HUMSP18A_T38 (SEQ ID NO: 123) | 915 | 946 |
| HUMSP18A_T42 (SEQ ID NO: 124) | 879 | 910 |
| HUMSP18A_T44 (SEQ ID NO: 125) | 928 | 959 |
| HUMSP18A_T46 (SEQ ID NO: 126) | 1750 | 1781 |

Segment cluster HUMSP18A N38 (SEQ ID NO:170) according to the present invention is supported by 79 libraries. The number of libraries was determined as previously described. This segment can be found in the following transcript(s): HUMSP18A_T14 (SEQ ID NO:114), HUMSP18A_T15 (SEQ ID NO:115), HUMSP18A_T20 (SEQ ID NO:116), HUMSP18A_T23 (SEQ ID NO:117), HUMSP18A_T27 (SEQ ID NO:118), HUMSP18A_T29 (SEQ ID NO:119), HUMSP18A_T30 (SEQ ID NO:120), HUMSP18A_T34 (SEQ ID NO:121), HUMSP18A_T35 (SEQ ID NO:122), HUMSP18A_T38 (SEQ ID NO:123), HUMSP18A_T42 (SEQ ID NO:124), HUMSP18A_T44 (SEQ ID NO:125) and HUMSP18A_T46 (SEQ ID NO:126). Table 177 below describes the starting and ending position of this segment on each transcript.

TABLE 177

Segment location on transcripts

| Transcript name | Segment starting position | Segment ending position |
|---|---|---|
| HUMSP18A_T14 (SEQ ID NO: 114) | 1290 | 1295 |
| HUMSP18A_T15 (SEQ ID NO: 115) | 1118 | 1123 |

TABLE 177-continued

Segment location on transcripts

| Transcript name | Segment starting position | Segment ending position |
|---|---|---|
| HUMSP18A_T20 (SEQ ID NO: 116) | 2559 | 2564 |
| HUMSP18A_T23 (SEQ ID NO: 117) | 1940 | 1945 |
| HUMSP18A_T27 (SEQ ID NO: 118) | 1118 | 1123 |
| HUMSP18A_T29 (SEQ ID NO: 119) | 1190 | 1195 |
| HUMSP18A_T30 (SEQ ID NO: 120) | 1290 | 1295 |
| HUMSP18A_T34 (SEQ ID NO: 121) | 934 | 939 |
| HUMSP18A_T35 (SEQ ID NO: 122) | 1118 | 1123 |
| HUMSP18A_T38 (SEQ ID NO: 123) | 1028 | 1033 |
| HUMSP18A_T42 (SEQ ID NO: 124) | 992 | 997 |
| HUMSP18A_T44 (SEQ ID NO: 125) | 1041 | 1046 |
| HUMSP18A_T46 (SEQ ID NO: 126) | 1863 | 1868 |

Figure 22:
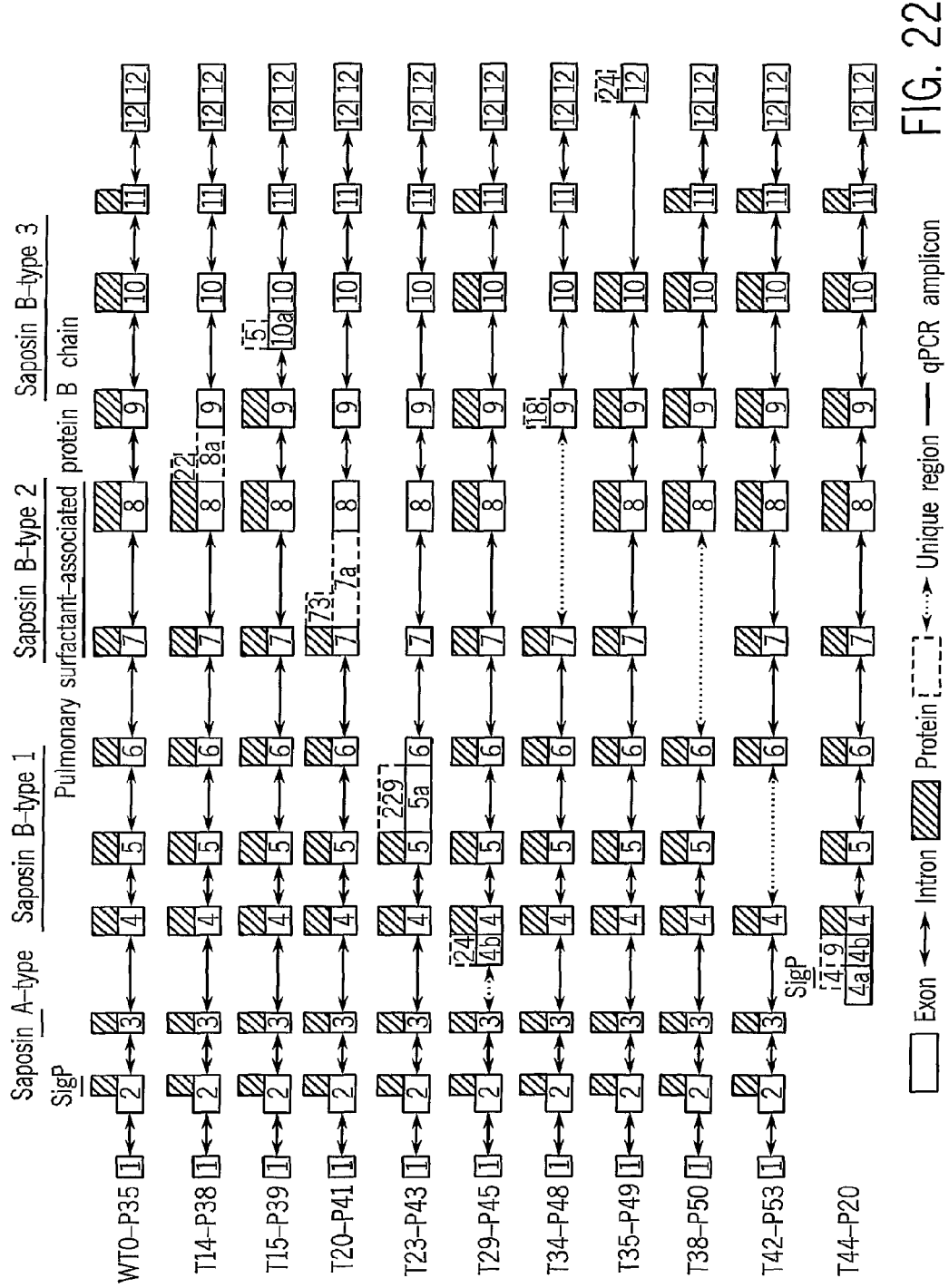
FIG. 22 shows the structure of the mRNA and protein variants of cluster HUMSP18A.

FIG. 22 shows the structure of the mRNA and protein variants of cluster HUMSP18A. "WT" refers to the known protein/mRNA.

Expression of *Homo sapiens* Surfactant, Pulmonary-Associated Protein B (SFTPB), Transcript Variant 2 HUMSP18A Transcripts which are Detectable by Amplicon as Depicted in Sequence Name HUMSP18A seg32 (SEQ ID NO: 407) in Normal and Cancerous Lung Tissues Expression of *Homo sapiens* surfactant, pulmonary-associated protein B (SFTPB), transcript variant 2 transcripts detectable by or according to seg32, HUMSP18A seg32 amplicon (SEQ ID NO: 407) and primers HUMSP18A seg32F (SEQ ID NO: 408) and HUMSP18A seg32R (SEQ ID NO: 409) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 3). Then the reciprocal of this ratio was calculated, to obtain a value of fold down-regulation for each sample relative to median of the normal PM samples.

Figure 23:
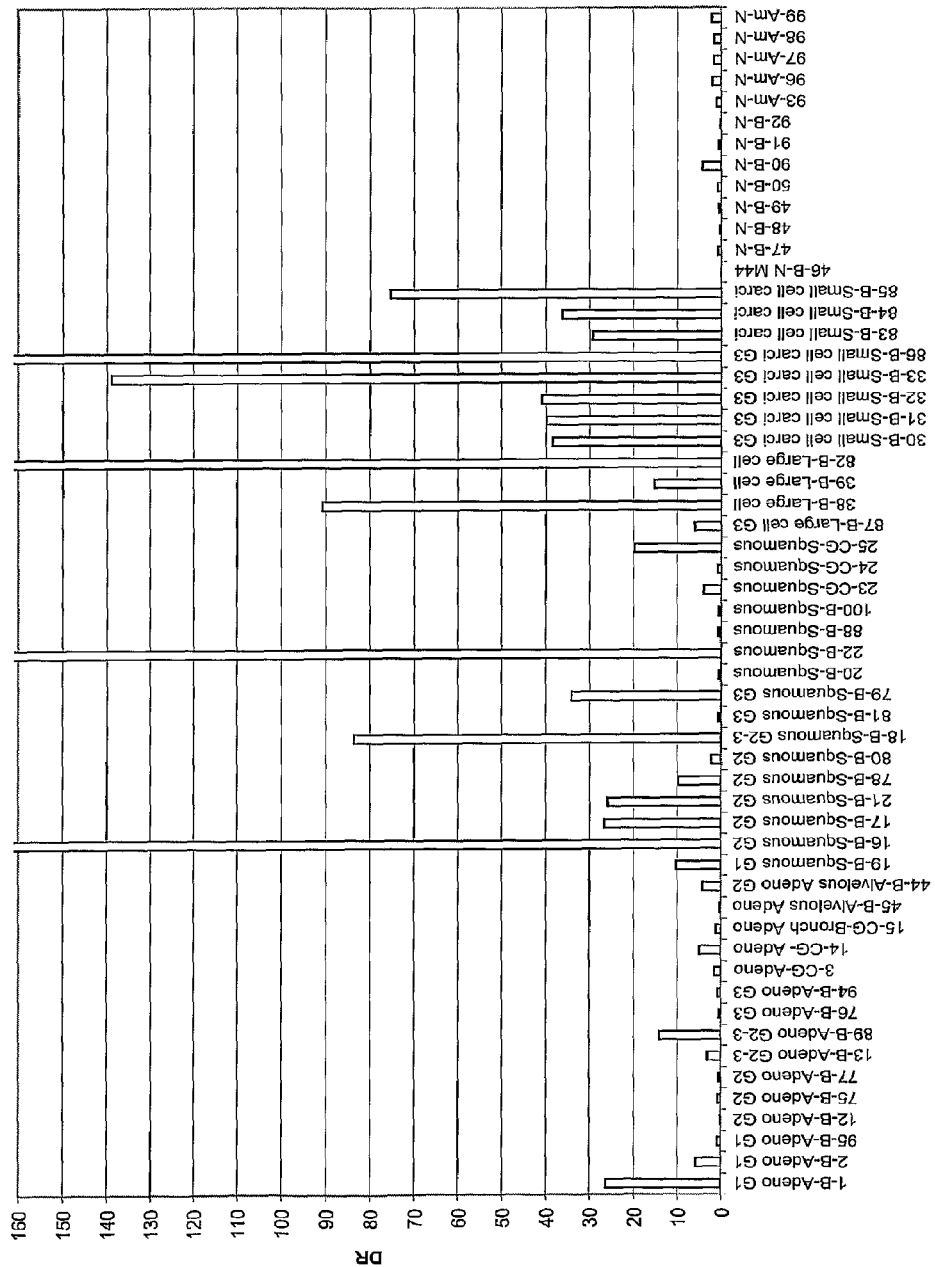
FIG. 23 is a histogram showing down regulation of the above-indicated *Homo sapiens* surfactant, pulmonary-associated protein B (SFTPB), transcript variant 2 transcripts (seg32) in cancerous lung samples relative to the normal samples.

FIG. 23 is a histogram showing down regulation of the above-indicated *Homo sapiens* surfactant, pulmonary-associated protein B (SFTPB), transcript variant 2 transcripts (seg32) in cancerous lung samples relative to the normal samples.

As is evident from FIG. 23, the expression of *Homo sapiens* surfactant, pulmonary-associated protein B (SFTPB), transcript variant 2 transcripts detectable by the above amplicon in cancer samples was significantly lower than in the non-cancerous samples (Sample Nos. 46-50, 90-93, 96-99 Table 3). Notably down regulation of at least 10 fold was found in 8 out of 16 squamous cell carcinoma samples, 3 out of 4 large cell carcinoma samples and in 8 out of 8 small cells carcinoma samples.

Statistical analysis was applied to verify the significance of these results, as described below.

The P value for the difference in the expression levels of *Homo sapiens* surfactant, pulmonary-associated protein B (SFTPB), transcript variant 2 transcripts detectable by the above amplicon in lung cancer samples versus the normal tissue samples was determined by T test as 8.99E-02 in squamous cell carcinoma, and 1.2E-02 in Small cell carcinoma.

Threshold of 10 fold down regulation was found to differentiate between cancer and normal samples with P value of 4.14E-03 in Squamous cell carcinoma, 7.14E-03 in Large cell carcinoma and 7.94E-06 in Small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HUMSP18A seg32F (SEQ ID NO: 408) forward primer; and HUMSP18A seg32R (SEQ ID NO: 409) reverse primer.

The present invention also preferably encompasses any amplicon obtained through the use of any suitable primer pair; for example, for the above experiment, the following amplicon was obtained as a non-limiting illustrative example only of a suitable amplicon: HUMSP18A seg32 (SEQ ID NO: 407).

Forward primer HUMSP18A seg32F (SEQ ID NO: 408):
CCCACTGCCCCCTCCTT

Reverse primer HUMSP18A seg32R (SEQ ID NO: 409):
TGGTTTCTGTCCTCCTTGGTG

Figure 24:
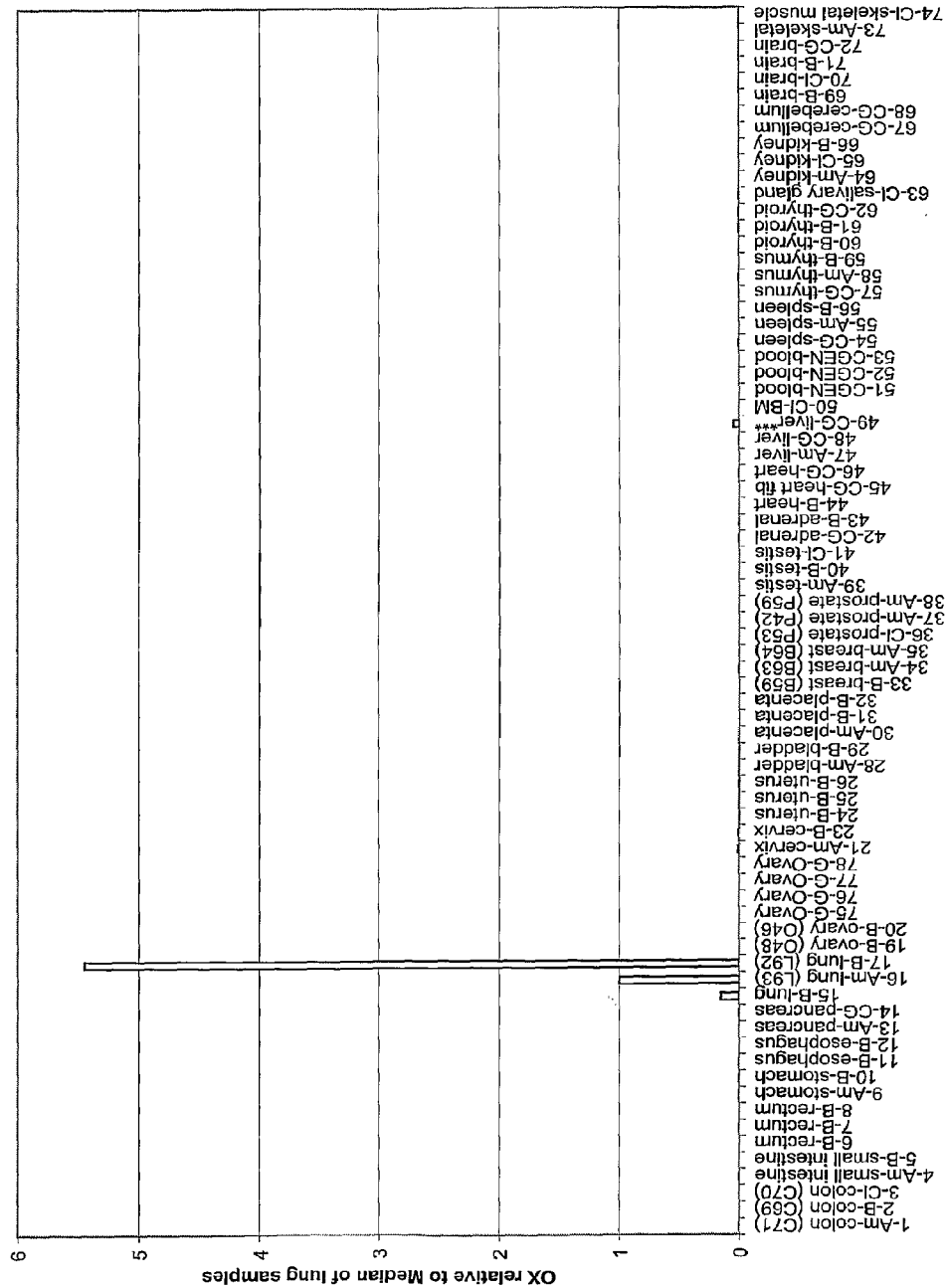
FIG. 24 shows expression of *Homo sapiens* surfactant, pulmonary-associated protein B (SFTPB) transcripts detectable by or according to seg32 in normal tissues.

Amplicon HUMSP18A seg32 (SEQ ID NO: 407):
CCCACTGCCCCCTCCTTAGCCCAATGCCTGCTCTCCTCCTCCCCCTACCC
TGCCACTGCATGACCCTCTCCCTCTGTGGTCCCACTGCAATGCACCAAGG
AGGACAGAAACCA Expression of *Homo sapiens* Surfactant, Pulmonary-Associated Protein B (SFTPB) HUMSP18A Transcripts which are Detectable by Amplicon as Depicted in Sequence Name HUMSP18A_seg32 (SEQ ID NO: 407) in Different Normal Tissues Expression of *Homo sapiens* surfactant, pulmonary-associated protein B (SFTPB) transcripts detectable by or according to seg32—HUMSP18A_seg32 (SEQ ID NO: 407) amplicon and primers HUMSP18A_seg32F (SEQ ID NO: 408) and HUMSP18A_seg32R (SEQ ID NO: 409) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 5 above), to obtain a value of relative expression of each sample relative to median of the lung samples. FIG. 24 shows expression of *Homo sapiens* surfactant, pulmonary-associated protein B (SFTPB) transcripts detectable by or according to seg32 in normal tissues.

```
Forward Primer (HUMSP18A_seg32F (SEQ ID NO: 408)):
CCCACTGCCCCCTCCTT

Reverse Primer (HUMSP18A_seg32R (SEQ ID NO: 409)):
TGGTTTCTGTCCTCCTTGGTG

Amplicon (HUMSP18A_seg32 (SEQ ID NO: 407)):
CCCACTGCCCCCTCCTTAGCCCAATGCCTGCTCTCCTCCTCCCCCTACCC
TGCCACTGCATGACCCTCTCCCTCTGTGGTCCCACTGCAATGCACCAAGG
AGGACAGAAACCA
```

Expression of *Homo sapiens* Surfactant, Pulmonary-Associated Protein B (SFTPB), Transcript Variant 2 HUMSP18A Transcripts which are Detectable by Amplicon as Depicted in Sequence Name HUMSP18A seg34-38WT (SEQ ID NO: 410) in Normal and Cancerous Lung Tissues Expression of *Homo sapiens* surfactant, pulmonary-associated protein B (SFTPB), transcript variant 2 transcripts detectable by or according to seg34-38, HUMSP18A seg34-38WT amplicon (SEQ ID NO: 410) and primers HUMSP18A seg34-38WTF (SEQ ID NO: 411) and HUMSP18A seg34-38WTR (SEQ ID NO: 412) was measured by real time PCR. In parallel the expression of four housekeeping genes— PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 3). Then the reciprocal of this ratio was calculated, to obtain a value of fold down-regulation for each sample relative to median of the normal PM samples.

Figure 25:
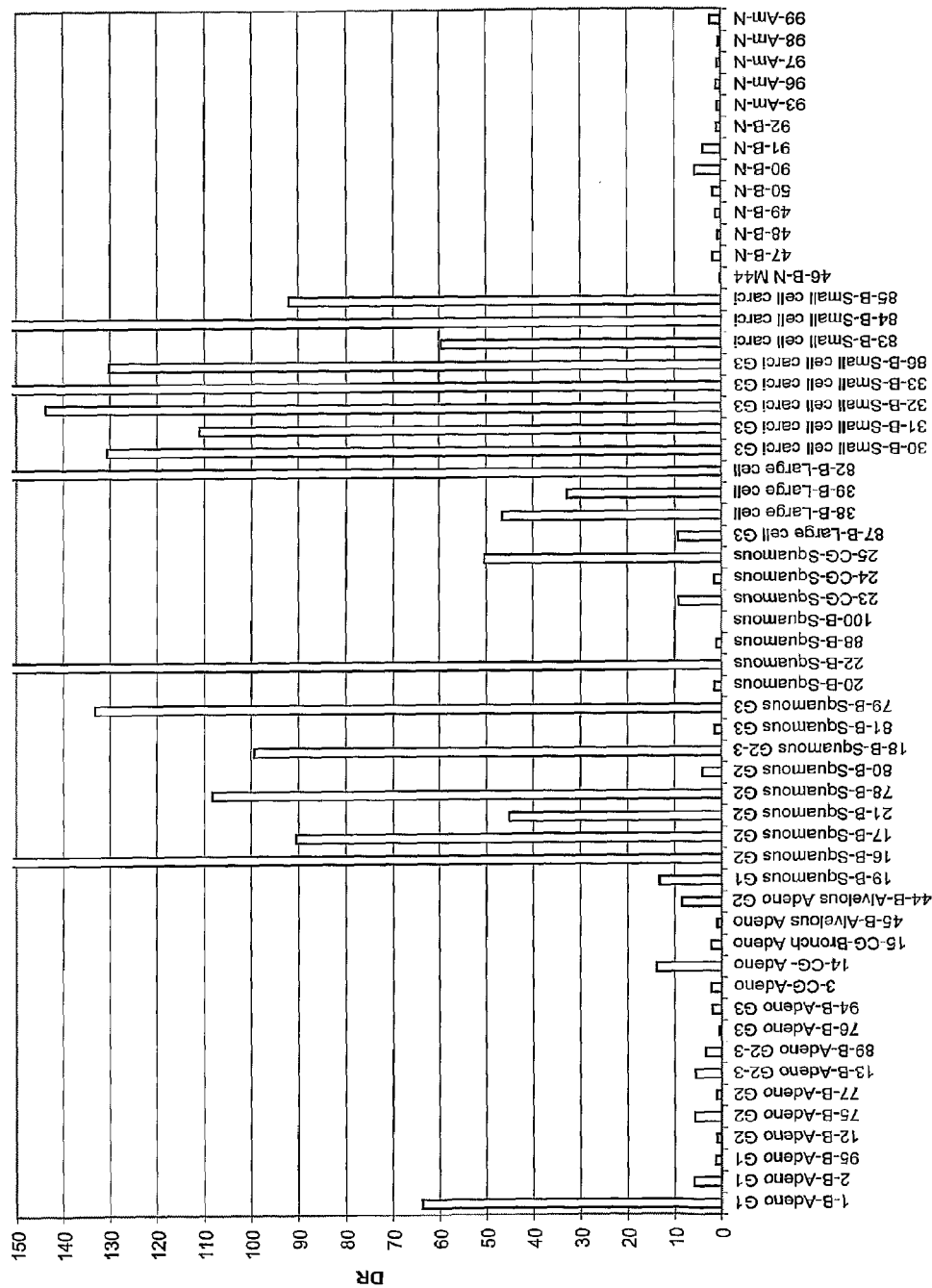
FIG. 25 is a histogram showing down regulation of the above-indicated *Homo sapiens* surfactant, pulmonary-associated protein B (SFTPB), transcript variant 2 transcripts in cancerous lung samples relative to the normal samples (seg34-38WT)

FIG. 25 is a histogram showing down regulation of the above-indicated *Homo sapiens* surfactant, pulmonary-associated protein B (SFTPB), transcript variant 2 transcripts in cancerous lung samples relative to the normal samples (seg34-38WT).

As is evident from FIG. 25, the expression of *Homo sapiens* surfactant, pulmonary-associated protein B (SFTPB), transcript variant 2 transcripts detectable by the above amplicon in cancer samples was significantly lower than in the non-cancerous samples (Sample Nos. 46-50, 90-93, 96-99 Table 3). Notably down regulation of at least 10 fold was found in 9 out of 16 squamous cell carcinoma samples, 3 out of 4 large cell carcinoma samples and in 8 out of 8 small cells carcinoma samples.

Statistical analysis was applied to verify the significance of these results, as described below.

The P value for the difference in the expression levels of *Homo sapiens* surfactant, pulmonary-associated protein B (SFTPB), transcript variant 2 transcripts detectable by the above amplicon in lung cancer samples versus the normal tissue samples was determined by T test as 5.64E-03 in Small cell carcinoma.

Threshold of 10 fold down regulation was found to differentiate between cancer and normal samples with P value of 1.66E-03 in Squamous cell carcinoma, 7.14E-03 in Large cell carcinoma and 7.94E-06 in Small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HUMSP18A seg34-38WTF (SEQ ID NO: 411) forward primer; and HUMSP18A seg34-38WTR (SEQ ID NO: 412) reverse primer.

The present invention also preferably encompasses any amplicon obtained through the use of any suitable primer pair; for example, for the above experiment, the following amplicon was obtained as a non-limiting illustrative example only of a suitable amplicon: HUMSP18A seg34-38WT (SEQ ID NO: 410).

```
Forward primer HUMSP18A seg34-38WTF (SEQ ID NO:
411):
GAGAATGGCTGCCGCG

Reverse primer HUMSP18A seg34-38WTR (SEQ ID NO:
412):
CATTGCCTGTGGTATGGCCT

Amplicon HUMSP18A seg34-38WT (SEQ ID NO: 410):
GAGAATGGCTGCCGCGAGACTCTGAGTGCCACCTCTGCAGTCCGTGACCA
CCCAGGCCGGGAACAGCAGCGAGCAGGCCATACCACAGGCAATG
```

Figure 26:
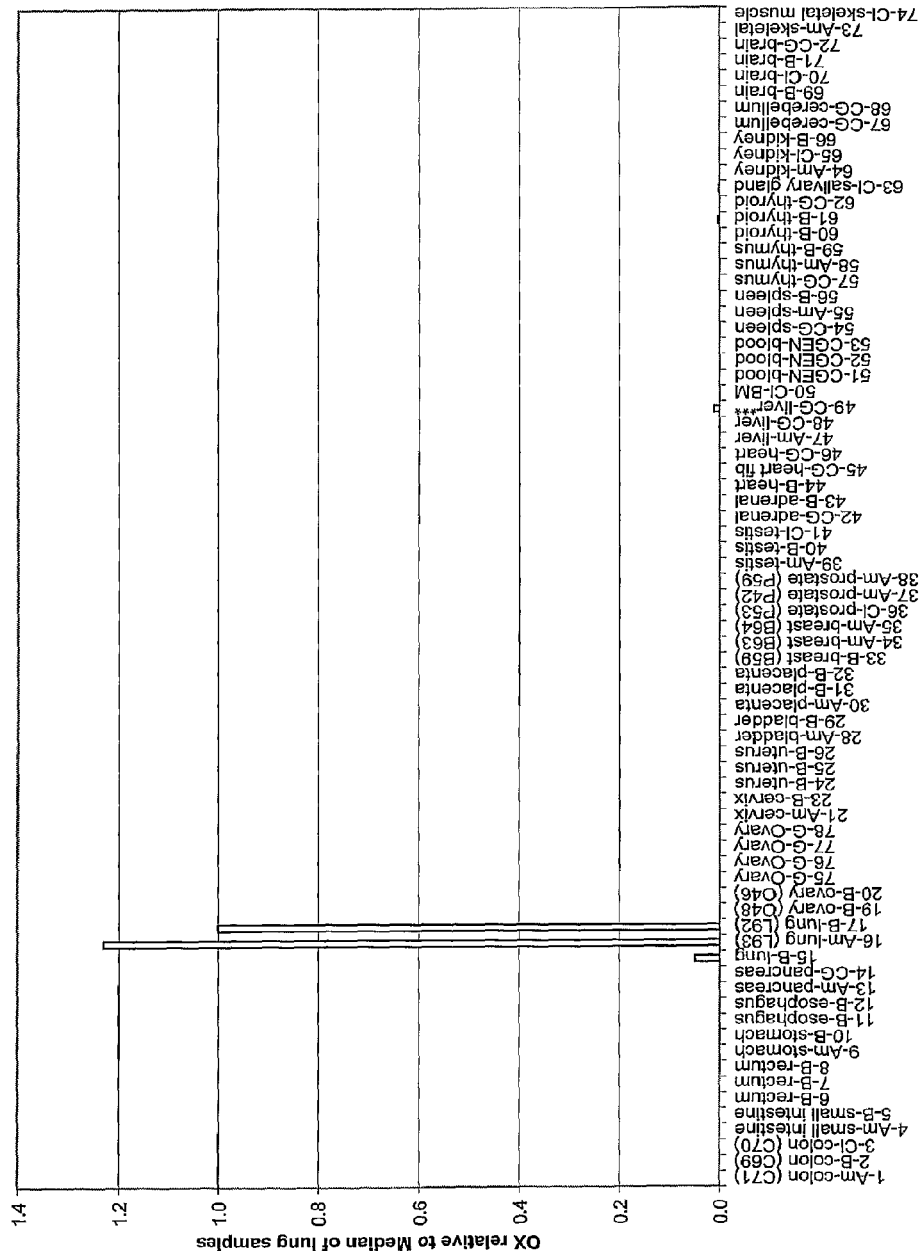
FIG. 26 shows the results of expression of *Homo sapiens* surfactant, pulmonary-associated protein B (SFTPB) transcripts detectable by or according to seg34-38WT on a normal panel.

Expression of *Homo sapiens* Surfactant, Pulmonary-Associated Protein B (SFTPB) HUMSP18A Transcripts which are Detectable by Amplicon as Depicted in Sequence Name HUMSP18A_seg34-38WT (SEQ ID NO: 410) in Different Normal Tissues Expression of *Homo sapiens* surfactant, pulmonary-associated protein B (SFTPB) transcripts detectable by or according to seg34-38WT—HUMSP18A_seg34-38WT (SEQ ID NO: 410) amplicon and primers HUMSP18A_seg34-38WTF (SEQ ID NO: 411) and HUMSP18A_seg34-38WTR (SEQ ID NO: 412) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 5 above), to obtain a value of relative expression of each sample relative to median of the lung samples. FIG. 26 shows the results of expression of *Homo sapiens* surfactant, pulmonary-associated protein B (SFTPB) transcripts detectable by or according to seg34-38WT on a normal panel.

```
Forward Primer (HUMSP18A_seg34-38WTF (SEQ ID NO:
411)):
GAGAATGGCTGCCGCG

Reverse Primer (HUMSP18A_seg34-38WTR (SEQ ID NO:
412)):
CATTGCCTGTGGTATGGCCT

Amplicon HUMSP18A_seg34-38WT (SEQ ID NO: 410):
GAGAATGGCTGCCGCGAGACTCTGAGTGCCACCTCTGCAGTCCGTGACCA
CCCAGGCCGGGAACAGCAGCGAGCAGGCCATACCACAGGCAATG
```

Description for Cluster F05068

Cluster F05068 features 4 transcript(s) and 15 segment(s) of interest, the names for which are given in Tables 178 and 179, respectively. The selected protein variants are given in table 180.

TABLE 178

Transcripts of interest
Transcript Name

F05068_T6 (SEQ ID NO: 189)

F05068_T7 (SEQ ID NO: 190)

F05068_T8 (SEQ ID NO: 191)

F05068_T9 (SEQ ID NO: 192)

TABLE 179

Segments of interest
Segment Name

F05068_N0 (SEQ ID NO: 196)

F05068_N5 (SEQ ID NO: 199)

F05068_N9 (SEQ ID NO: 203)

F05068_N13 (SEQ ID NO: 207)

F05068_N15 (SEQ ID NO: 209)

F05068_N16 (SEQ ID NO: 210)

F05068_N3 (SEQ ID NO: 197)

F05068_N4 (SEQ ID NO: 198)

F05068_N6 (SEQ ID NO: 200)

F05068_N7 (SEQ ID NO: 201)

F05068_N8 (SEQ ID NO: 202)

F05068_N10 (SEQ ID NO: 204)

F05068_N11 (SEQ ID NO: 205)

F05068_N12 (SEQ ID NO: 206)

F05068_N14 (SEQ ID NO: 208)

TABLE 180

Proteins of interest

| Protein Name | Corresponding Transcript(s) |
|---|---|
| F05068_P6 (SEQ ID NO: 193) | F05068_T9 (SEQ ID NO: 192) |
| F05068_P9 (SEQ ID NO: 194) | F05068_T6 (SEQ ID NO: 189); F05068_T7 (SEQ ID NO: 190) |
| F05068_P10 (SEQ ID NO: 195) | F05068_T8 (SEQ ID NO: 191) |

These sequences are variants of the known protein ADM precursor (SwissProt accession identifier ADML_HUMAN (SEQ ID NO:413)), referred to herein as the previously known protein.

Protein ADM precursor is known or believed to have the following function(s): AM and PAMP are potent hypotensive and vasodilatator agents. Numerous actions have been reported most related to the physiologic control of fluid and electrolyte homeostasis. In the kidney, am is diuretic and natriuretic, and both am and pamp inhibit aldosterone secretion by direct adrenal actions. In pituitary gland, both peptides at physiologically relevant doses inhibit basal ACTH secretion. Both peptides appear to act in brain and pituitary gland to facilitate the loss of plasma volume, actions which complement their hypotensive effects in blood vessels. The sequence for protein ADM precursor is given at the end of the application, as "ADM precursor amino acid sequence". Known polymorphisms for this sequence are as shown in Table 181.

TABLE 181

Amino acid mutations for Known Protein

| SNP position(s) on amino acid sequence | Comment |
|---|---|
| 50 | S -> R (in dbSNP:5005). /FTId = VAR_014861 |

Protein ADM precursor localization is believed to be Secreted.

Adrenomedullin, a hypotensive peptide found in human pheochromocytoma, consists of 52 amino acids, has 1 intramolecular disulfide bond, and shows a slight homology with the calcitonin gene-related peptide. It may function as a hormone in circulation control because it is found in blood in a considerable concentration. The precursor, called preproadrenomedullin, is 185 amino acids long. By RNA-blot analysis, human adrenomedullin mRNA was found to be highly expressed in several tissues.

In the final step of production of adrenomedullin (AM), an inactive intermediate form of glycine-extended AM (AM-glycine) is converted to the active mature form of adrenomedullin (AM-mature) by enzymatic amidation. Recent studies have revealed that AM-mature and AM-glycine circulate in human plasma.

According to optional embodiments of the present invention, the variants of F05068 described below may optionally be in the form of "AM variant-glycine", in which the variant sequence features an additional glycine residue at the N-terminus.

TABLE 182

| Indication | Reason | reference |
|---|---|---|
| Diagnosis of children with acute rheumatic fever | Plasma urinary adrenomedullin and total nitrite levels were significantly higher in children with ARF, irrespective of | Clin Biochem. June 2005; 38 (6): 526-30. |

TABLE 182-continued

| Indication | Reason | reference |
|---|---|---|
| | whether they were in the acute or convalescent phase of disease. | |
| Diagnosis and clinical monitoring of pheochromocytoma, alone or in combination with chromogranin A | The mean plasma adrenomedullin concentration (+/− SD) in patients with pheochromocytomas (27.5 +/− 10.4 pg/mL) was significantly higher (P < 0.001) than that in HS (13.8 +/− 4.5 pg/mL) and in patients with non-functioning adrenocortical adenomas (16.6 +/− 7.3 pg/mL). Plasma CgA levels correlated with plasma adrenomedullin levels (r = 0.501; P < 0.02) and with plasma metanephrine levels (r = 0.738; P < 0.0001) in patients with pheochromocytomas. In 11 patients with pheochromocytomas plasma CgA and adrenomedullin concentrations significantly decreased after tumor removal (P < 0.001 for both). | Tumori. 2005 January-February; 91(1):53-8. Horm Metab Res. 2001 May; 33(5): 290-4. Cancer Detect Prev. 1997; 21(1): 51-4. |
| Diagnosis of vascular and proliferative retinal diseases, alone or in combination with leptin. | The mean vitreous adrenomedullin levels (63.9+/− 7.1 pmol/l) were significantly higher (p < 0.05) in proliferative diabetic retinopathy patients than in patients with other retinal diseases including macular hole and epiretinal membrane (34.25+/−3.0 pmol/l). | Ophthalmologica. 2005 March-April; 219(2): 107-11. Am J Ophthalmol. 1999 December; 128(6): 765-7. |
| predictor of patient (poor) prognosis in acute myocardial infarction (AMI), alone or in combination with brain natriuretic peptide (BNP), atrial natriuretic peptide (ANP), renin, aldosterone, adrenomedullin, epinephrine and norepinephrine | Multivariate analysis identified only high levels of adrenomedullin as an independent related factor of cardiogenic shock (risk ratio: 5.84, 95% C.I.: 1.80-18.95, p = 0.003), and as an independent predictor of short-term mortality (risk ratio: 16.16, 95% C.I.: 1.38-189.71, p = 0.03). . . . acute-phase plasma adrenomedullin concentrations may be the most useful predictor of patient prognosis in the setting of AMI, out of the 7 types of cardiovascular peptides involved in neurohumoral activation. Plasma adrenomedullin concentrations increased in the acute phase of myocardial infarction in proportion with clinical severity suggesting that adrenomedullin may play an important role in the pathophysiology of myocardial infarction. | Intern Med. 2004 November; 43(11): 1015-22. Angiology. 2005 January-February; 56(1): 35-42. Heart. 1998 January; 79(1): 39-44 |
| Diagnosis of traumatic brain injury (TBI) in children CSF. | Adrenomedullin concentration was markedly elevated in CSF of children following TBI versus control (mean level 10.65 vs 1.51 fmol/ml, p = 0.006). All 36 case samples had an adrenomedullin concentration above the median value for the controls (1.52 fmol/ml). | Acta Neurochir Suppl. 2000; 76: 419-21 |
| Detection of pressure-overloaded (PO) heart failure (HF) and volume-overloaded (VO)-HF. | Plasma Adrenomedullin-mature (VO-HF: +59%, PO-HF: +65%, P < .05) and Adrenomedullin-glycine (VO-HF: +43%, PO-HF: +50%, P < 0.05) were similarly higher | J Card Fail. 2004 August; 10(4): 321-7. Clin Sci (Load). 2002 June; 102(6): 669-77. Heart. 2002 March; 87(3): 242-6 |

TABLE 182-continued

| Indication | Reason | reference |
|---|---|---|
| | in the 2 HF groups than in the control group. | |
| Differential diagnosis of Squamous Cell Lung Carcinoma VS Adenocarcinoma and/or Carcinoid | Significance 1.2E−4 | Proc Natl Acad Sci USA. 2001 Nov. 20; 98(24): 13790-5. |

The following GO Annotation(s) apply to the previously known protein. The following annotation(s) were found: cAMP biosynthesis; cell-cell signaling; circulation; pregnancy; progesterone biosynthesis; response to wounding; signal transduction, which are annotation(s) related to Biological Process; receptor binding, which are annotation(s) related to Molecular Function; and extracellular space; soluble fraction, which are annotation(s) related to Cellular Component.

The GO assignment relies on information from one or more of the SwissProt/TremBl Protein knowledgebase or Locuslink.

Cluster F05068 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 27 refer to weighted expression of ESTs in each category, as "parts per million" (ratio of the expression of ESTs for a particular cluster to the expression of all ESTs in that category, according to parts per million).

Figure 27:
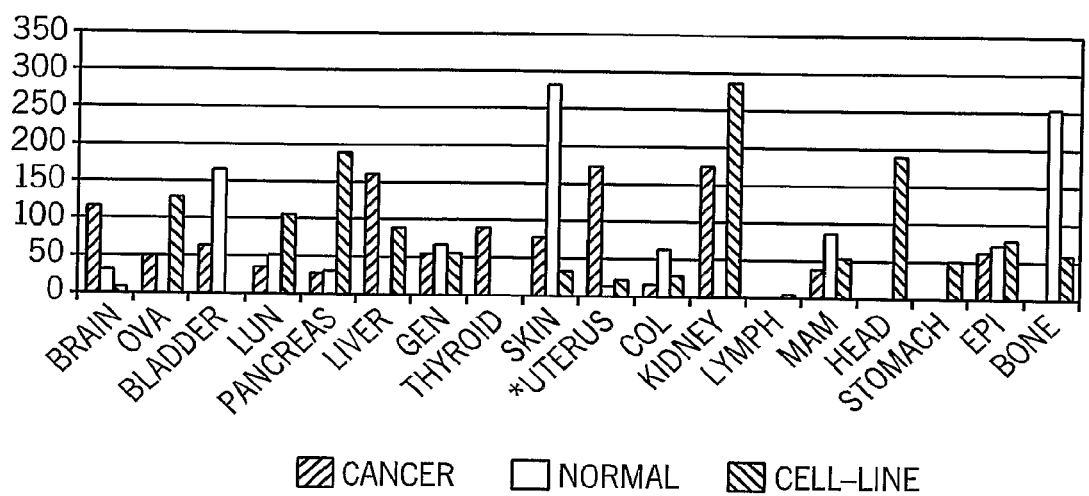
FIG. 27 shows cancer and cell-line vs. normal tissue expression for cluster F05068.

Overall, the following results were obtained as shown with regard to the histograms in FIG. 27 and Table 183. This cluster is overexpressed (at least at a minimum level) in the following pathological conditions: uterine malignancies.

TABLE 183

Normal tissue distribution

| Name of Tissue | Number |
|---|---|
| brain | 31 |
| ovary | 0 |
| bladder | 164 |
| lung | 52 |
| pancreas | 30 |
| liver | 0 |
| general | 66 |
| Thyroid | 0 |
| skin | 281 |
| uterus | 13 |
| colon | 64 |
| kidney | 50 |
| lymph nodes | 0 |
| breast | 86 |
| head and neck | 0 |
| stomach | 0 |
| epithelial | 71 |
| bone | 253 |

TABLE 184

P values and ratios for expression in cancerous tissue

| Name of Tissue | P1 | P2 | SP1 | R3 | SP2 | R4 |
|---|---|---|---|---|---|---|
| brain | 5.5e−01 | 7.1e−01 | 2.3e−03 | 1.7 | 9.9e−02 | 0.9 |
| ovary | 3.8e−01 | 2.6e−01 | 3.2e−01 | 2.4 | 1.6e−01 | 2.5 |
| bladder | 7.6e−01 | 8.0e−01 | 9.4e−01 | 0.5 | 9.9e−01 | 0.4 |
| lung | 6.8e−01 | 5.0e−01 | 8.5e−01 | 0.7 | 3.8e−01 | 1.0 |

TABLE 184-continued

P values and ratios for expression in cancerous tissue

| Name of Tissue | P1 | P2 | SP1 | R3 | SP2 | R4 |
|---|---|---|---|---|---|---|
| pancreas | 4.7e−01 | 2.8e−01 | 7.0e−01 | 0.9 | 1.0e−01 | 1.4 |
| liver | 1.8e−01 | 1.3e−01 | 2.3e−01 | 4.3 | 2.4e−01 | 2.6 |
| general | 3.8e−01 | 2.7e−01 | 8.3e−01 | 0.8 | 8.8e−01 | 0.8 |
| Thyroid | 2.9e−01 | 2.9e−01 | 6.8e−01 | 1.7 | 6.8e−01 | 1.7 |
| skin | 7.2e−01 | 6.3e−01 | 9.6e−01 | 0.3 | 1.0e+00 | 0.1 |
| uterus | 8.7e−02 | 2.2e−01 | 2.0e−03 | 3.2 | 2.2e−02 | 2.2 |
| colon | 6.8e−01 | 6.7e−01 | 9.7e−01 | 0.5 | 9.6e−01 | 0.6 |
| kidney | 3.4e−01 | 3.5e−01 | 6.1e−02 | 1.8 | 1.0e−02 | 2.1 |
| lymph nodes | N/A | 3.4e−01 | N/A | N/A | N/A | N/A |
| breast | 7.8e−01 | 6.3e−01 | 9.1e−01 | 0.6 | 8.9e−01 | 0.7 |
| head and neck | 2.1e−01 | 1.1e−01 | N/A | N/A | 3.2e−01 | 2.3 |
| stomach | 3.3e−01 | 2.6e−01 | N/A | N/A | 4.0e−01 | 1.8 |
| epithelial | 1.2e−01 | 3.9e−02 | 7.7e−01 | 0.7 | 5.8e−01 | 0.9 |
| bone | 7.5e−01 | 8.8e−01 | 1.0e+00 | 0.1 | 1.0e+00 | 0.3 |

As noted above, cluster F05068 features 4 transcript(s), which were listed in Table 178 above. These transcript(s) encode for protein(s) which are variant(s) of protein ADM precursor. A description of each variant protein according to the present invention is now provided.

Variant protein F05068_P6 (SEQ ID NO:193) according to the present invention has an amino acid sequence as given at the end of the application; it is encoded by transcript(s) F05068_T9 (SEQ ID NO:192). An alignment is given to the known protein (ADM precursor) in the alignment table on the attached CD-ROM. A brief description of the relationship of the variant protein according to the present invention to each such aligned protein is as follows:

1. Comparison report between F05068_P6 (SEQ ID NO:193) and ADML_HUMAN (SEQ ID NO:413):

A. An isolated chimeric polypeptide as set forth in F05068_P6 (SEQ ID NO:193), comprising a first amino acid sequence being at least 90% homologous to MKLVS-VALMYLGSLAFLGADTARLDVASE-FRKKWNKWALSRGKRELRMSSSYPT-GLADVKAGPAQTLIRPQ DMKGASRSPEDS corresponding to amino acids 1-83 of ADML_HUMAN (SEQ ID NO:413), which also corresponds to amino acids 1-83 of F05068_P6 (SEQ ID NO:193), and a second amino acid sequence being at least 70%, optionally at least 80%, preferably at least 85%, more preferably at least 90% and most preferably at least 95% homologous to a polypeptide having the sequence CLSSPSPRPQQSGCRPHPSQALPPE-HEQLPGPPELWLPLRDVHGAEAGTPDLPVHR (SEQ ID NO: 490) corresponding to amino acids 84-139 of F05068_P6 (SEQ ID NO:193), wherein said first amino acid sequence and second amino acid sequence are contiguous and in a sequential order.

B. An isolated polypeptide encoding for an edge portion of F05068_P6 (SEQ ID NO:193), comprising an amino acid sequence being at least 70%, optionally at least about 80%, preferably at least about 85%, more preferably at least about 90% and most preferably at least about 95% homologous to the sequence CLSSPSPRPQQSGCRPHPSQALPPE-HEQLPGPPELWLPLRDVHGAEAGTPDLPVHR (SEQ ID NO: 490) of F05068_P6 (SEQ ID NO:193).

The location of the variant protein was determined according to results from a number of different software programs and analyses, including analyses from SignalP and other specialized programs. The variant protein is secreted.

Variant protein F05068_P6 (SEQ ID NO:193) also has the following non-silent SNPs (Single Nucleotide Polymorphisms) as listed in Table 185, (given according to their position(s) on the amino acid sequence, with the alternative amino acid(s) listed; the presence of known SNPs in variant protein F05068_P6 (SEQ ID NO:193) sequence provides support for the deduced sequence of this variant protein according to the present invention).

TABLE 185

Amino acid mutations

| SNP position(s) on amino acid sequence | Alternative amino acid(s) |
|---|---|
| 4 | V -> F |
| 10 | Y -> C |
| 50 | S -> R |
| 118 | L -> |

The phosphorylation sites of variant protein F05068_P6 (SEQ ID NO:193), as compared to the known protein, are described in Table 186 (given according to their position(s) on the amino acid sequence in the first column; the second column indicates whether the phosphorylation site is present in the variant protein; and the last column indicates whether the position is different on the variant protein).

TABLE 186

Phosphorylation site(s)

| Position(s) on known amino acid sequence | Present in variant protein? | Position(s) on variant protein |
|---|---|---|
| 41 | Yes | 41 |
| 146 | No | |

The variant protein has the following domains, as determined by using InterPro. The domains are described in Table 187:

TABLE 187

InterPro domain(s)

| Domain description | Analysis type | Position(s) on protein |
|---|---|---|
| Adrenomedullin | FPrintScan | 2-22, 30-46, 49-67 |
| Adrenomedullin | HMMPfam | 21-139 |

Variant protein F05068_P6 (SEQ ID NO:193) is encoded by the following transcript(s): F05068_T9 (SEQ ID NO:192), for which the coding portion starts at position 267 and ends at position 683. The transcript also has the following SNPs as listed in Table 188 (given according to their position on the nucleotide sequence, with the alternative nucleic acid listed; the presence of known SNPs in variant protein F05068_P6 (SEQ ID NO:193) sequence provides support for the deduced sequence of this variant protein according to the present invention).

TABLE 188

Nucleic acid SNPs

| Polymorphism | SNP position(s) on nucleotide sequence |
|---|---|
| C -> T | 26, 206, 960, 1163 |
| T -> | 132, 177, 164, 619, 1338 |
| G -> | 245, 1073 |
| C -> | 259, 741, 760, 960. 1151, 1035, 1229 |
| G -> T | 276, 1071 |
| A -> G | 295, 1434, 1452 |
| A -> C | 317, 1452 |
| C -> G | 416, 760, 1035, 1151 |
| G -> C | 443, 904, 1461 |
| C -> A | 741, 1071 |
| -> C | 909 |
| T -> G | 1052, 1338, 1196 |
| T -> C | 1196, 1549 |

Variant protein F05068_P9 (SEQ ID NO:194) according to the present invention has an amino acid sequence as given at the end of the application; it is encoded by transcript(s) F05068_T6 (SEQ ID NO:189) and F05068_T7 (SEQ ID NO:190). An alignment is given to the known protein (ADM precursor) in the alignment table on the attached CD-ROM. A brief description of the relationship of the variant protein according to the present invention to each such aligned protein is as follows:

1. Comparison report between F05068_P9 (SEQ ID NO:194) and ADML_HUMAN (SEQ ID NO:413):

A. An isolated chimeric polypeptide as set forth in F05068_P9 (SEQ ID NO:194), comprising a amino acid sequence being at least 90% homologous to MKLVSVALMYLGSLAFLGADTARLDVASEFRKK corresponding to amino acids 1-33 of ADML_HUMAN (SEQ ID NO:413), which also corresponds to amino acids 1-33 of F05068_P9 (SEQ ID NO:194).

The location of the variant protein was determined according to results from a number of different software programs and analyses, including analyses from SignalP and other specialized programs. The variant protein is secreted.

Variant protein F05068_P9 (SEQ ID NO:194) also has the following non-silent SNPs (Single Nucleotide Polymorphisms) as listed in Table 189, (given according to their position(s) on the amino acid sequence, with the alternative amino acid(s) listed; the presence of known SNPs in variant protein F05068_P9 (SEQ ID NO:194) sequence provides support for the deduced sequence of this variant protein according to the present invention).

TABLE 189

Amino acid mutations

| SNP position(s) on amino acid sequence | Alternative amino acid(s) |
|---|---|
| 4 | V -> F |
| 10 | Y -> C |

The phosphorylation sites of variant protein F05068_P9 (SEQ ID NO:194), as compared to the known protein, are described in Table 190 (given according to their position(s) on the amino acid sequence in the first column; the second column indicates whether the phosphorylation site is present in the variant protein; and the last column indicates whether the position is different on the variant protein).

TABLE 190

| Phosphorylation site(s) | | |
|---|---|---|
| Position(s) on known amino acid sequence | Present in variant protein? | Position(s) on variant protein |
| 41 | No | |
| 146 | No | |

The variant protein has the following domains, as determined by using InterPro. The domains are described in Table 191:

TABLE 191

| InterPro domain(s) | | |
|---|---|---|
| Domain description | Analysis type | Position(s) on protein |
| Adrenomedullin | FPrintScan | 2-22, 30-33 |

Variant protein F05068_P9 (SEQ ID NO:194) is encoded by the following transcript(s): F05068_T6 (SEQ ID NO:189) and F05068_T7 (SEQ ID NO:190), for which the coding portion starts at position 267 and ends at position 365. The transcript also has the following SNPs as listed in Table 192 (given according to their position on the nucleotide sequence, with the alternative nucleic acid listed; the presence of known SNPs in variant protein F05068_P9 (SEQ ID NO:194) sequence provides support for the deduced sequence of this variant protein according to the present invention).

Table 192

| Nucleic acid SNPs | |
|---|---|
| Polymorphism | SNP position(s) on nucleotide sequence |
| C -> T | 26, 206, 1079, 1282 |
| T -> | 132, 164, 177, 738, 1457 |
| G -> | 245, 1192 |
| C -> | 259, 860, 879, 1079, 1270, 1190, 1154, 1348 |
| G -> T | 276 |
| A -> G | 295, 1553, 1571 |
| A -> C | 317, 1571 |
| C -> G | 566, 879, 1154, 1270 |
| G -> C | 593, 1023, 1580 |
| C -> A | 860, 1190 |
| -> C | 1028 |
| T -> G | 1171, 1315, 1457 |
| T -> C | 1315, 1668 |

The coding portion of transcript F05068_T7 (SEQ ID NO:190) coding portion starts at position 267 and ends at position 365. The transcript also has the following SNPs as listed in Table 193 (given according to their position on the nucleotide sequence, with the alternative nucleic acid listed; the presence of known SNPs in variant protein F05068_P9 (SEQ ID NO:194) sequence provides support for the deduced sequence of this variant protein according to the present invention).

TABLE 193

| Nucleic acid SNPs | |
|---|---|
| Polymorphism | SNP position(s) on nucleotide sequence |
| C -> T | 26, 206, 933, 1136 |
| T -> | 132, 164, 177, 592, 1311 |
| G -> | 245, 1046 |
| C -> | 259, 714, 733, 933, 1008, 1124, 1202, 1044 |
| G -> T | 276 |
| A -> G | 295, 1407, 1425 |
| A -> C | 317, 1425 |
| C -> G | 420, 733, 1008, 1124 |
| G -> C | 447, 877, 1434 |
| C -> A | 714, 1044 |
| -> C | 882 |
| T -> G | 1025, 1169, 1311 |
| T -> C | 1169, 1522 |

Variant protein F05068_P10 (SEQ ID NO:195) according to the present invention has an amino acid sequence as given at the end of the application; it is encoded by transcript(s) F05068_T8 (SEQ ID NO:191). An alignment is given to the known protein (ADM precursor) in the alignment table on the attached CD-ROM. A brief description of the relationship of the variant protein according to the present invention to each such aligned protein is as follows:

1. Comparison report between F05068_P10 (SEQ ID NO:195) and ADML_HUMAN (SEQ ID NO:413):

A. An isolated chimeric polypeptide as set forth in F05068_P10 (SEQ ID NO:195), comprising a first amino acid sequence being at least 90% homologous to MKLVS-VALMYLGSLAFLGADTARLDVASE-FRKKWNKWALSRGKRELRMSSSYPT-GLADVKAGPAQTLIRPQ DMKGASRSPED corresponding to amino acids 1-82 of ADML_HUMAN (SEQ ID NO:413), which also corresponds to amino acids 1-82 of F05068_P10 (SEQ ID NO:195), and an amino acid R, wherein said first amino acid sequence and said amino acid are contiguous and in a sequential order.

The location of the variant protein was determined according to results from a number of different software programs and analyses, including analyses from SignalP and other specialized programs. The variant protein is secreted.

Variant protein F05068_P10 (SEQ ID NO:195) also has the following non-silent SNPs (Single Nucleotide Polymorphisms) as listed in Table 194, (given according to their position(s) on the amino acid sequence, with the alternative amino acid(s) listed; the presence of known SNPs in variant protein F05068_P10 (SEQ ID NO:195) sequence provides support for the deduced sequence of this variant protein according to the present invention).

TABLE 194

| Amino acid mutations | |
|---|---|
| SNP position(s) on amino acid sequence | Alternative amino acid(s) |
| 4 | V -> F |
| 10 | Y -> C |
| 50 | S -> R |

The phosphorylation sites of variant protein F05068_P10 (SEQ ID NO:195), as compared to the known protein, are described in Table 195 (given according to their position(s) on the amino acid sequence in the first column; the second column indicates whether the phosphorylation site is present in the variant protein; and the last column indicates whether the position is different on the variant protein).

TABLE 195

| Phosphorylation site(s) | | |
| --- | --- | --- |
| Position(s) on known amino acid sequence | Present in variant protein? | Position(s) on variant protein |
| 41 | Yes | 41 |
| 146 | No | |

The variant protein has the following domains, as determined by using InterPro. The domains are described in Table 196:

TABLE 196

| InterPro domain(s) | | |
| --- | --- | --- |
| Domain description | Analysis type | Position(s) on protein |
| Adrenomedullin | FPrintScan | 2-22, 30-46, 49-67 |

Variant protein F05068_P10 (SEQ ID NO:195) is encoded by the following transcript(s): F05068_T8 (SEQ ID NO:191), for which the coding portion starts at position 267 and ends at position 515. The transcript also has the following SNPs as listed in Table 197 (given according to their position on the nucleotide sequence, with the alternative nucleic acid listed; the presence of known SNPs in variant protein F05068_P10 (SEQ ID NO:195) sequence provides support for the deduced sequence of this variant protein according to the present invention).

TABLE 197

| Nucleic acid SNPs | |
| --- | --- |
| Polymorphism | SNP position(s) on nucleotide sequence |
| C -> T | 26, 206, 1162, 1365 |
| T -> | 132, 164, 177, 821, 1540 |
| G -> | 245, 1275 |
| C -> | 259, 943, 962, 1162, 1237, 1273, 1431, 1353 |
| G -> T | 276 |
| A -> G | 295, 1636, 1654 |
| A -> C | 317, 1654 |
| C -> G | 416, 589, 962, 1237, 1353 |
| G -> C | 443 |
| C -> A | 943, 1273 |
| G -> C | 1106, 1663 |
| -> C | 1111 |
| T -> G | 1254, 1398, 1540 |
| T -> C | 1398, 1751 |

As noted above, cluster F05068 features 15 segment(s), which were listed in Table 179 above and for which the sequence(s) are given. These segment(s) are portions of nucleic acid sequence(s) which are described herein separately because they are of particular interest. A description of segments 3, 5, 9, and 13 according to the present invention is now provided.

Segment cluster F05068 N5 (SEQ ID NO:199) according to the present invention is supported by 19 libraries. The number of libraries was determined as previously described. This segment can be found in the following transcript(s): F05068_N5 (SEQ ID NO:189). Table 198 below describes the starting and ending position of this segment on each transcript.

TABLE 198

| Segment location on transcripts | | |
| --- | --- | --- |
| Transcript name | Segment starting position | Segment ending position |
| F05068_T6 (SEQ ID NO: 189) | 369 | 514 |

Segment cluster F05068_N9 (SEQ ID NO:203) according to the present invention is supported by 16 libraries. The number of libraries was determined as previously described. This segment can be found in the following transcript(s): F05068_T8 (SEQ ID NO:191). Table 199 below describes the starting and ending position of this segment on each transcript.

TABLE 199

| Segment location on transcripts | | |
| --- | --- | --- |
| Transcript name | Segment starting position | Segment ending position |
| F05068_T8 (SEQ ID NO: 191) | 515 | 716 |

Segment cluster F05068_N13 (SEQ ID NO:207) according to the present invention is supported by 180 libraries. The number of libraries was determined as previously described. This segment can be found in the following transcript(s): F05068_T6 (SEQ ID NO:189), F05068_T7 (SEQ ID NO:190), F05068_T8 (SEQ ID NO:191) and F05068_T9 (SEQ ID NO:192). Table 200 below describes the starting and ending position of this segment on each transcript.

TABLE 200

| Segment location on transcripts | | |
| --- | --- | --- |
| Transcript name | Segment starting position | Segment ending position |
| F05068_T6 (SEQ ID NO: 189) | 749 | 909 |
| F05068_T7 (SEQ ID NO: 190) | 603 | 763 |
| F05068_T8 (SEQ ID NO: 191) | 832 | 992 |
| F05068_T9 (SEQ ID NO: 192) | 630 | 790 |

According to an optional embodiment of the present invention, short segments related to the above cluster are also provided. These segments are up to about 120 bp in length, and so are included in a separate description.

Segment cluster F05068_N3 (SEQ ID NO:197) according to the present invention is supported by 200 libraries. The number of libraries was determined as previously described. This segment can be found in the following transcript(s): F05068_T6 (SEQ ID NO:189), F05068_T7 (SEQ ID NO:190), F05068_T8 (SEQ ID NO:191) and F05068_T9 (SEQ ID NO:192). Table 201 below describes the starting and ending position of this segment on each transcript.

TABLE 201

Segment location on transcripts

| Transcript name | Segment starting position | Segment ending position |
|---|---|---|
| F05068_T6 (SEQ ID NO: 189) | 246 | 364 |
| F05068_T7 (SEQ ID NO: 190) | 246 | 364 |
| F05068_T8 (SEQ ID NO: 191) | 246 | 364 |
| F05068_T9 (SEQ ID NO: 192) | 246 | 364 |

Figure 28:
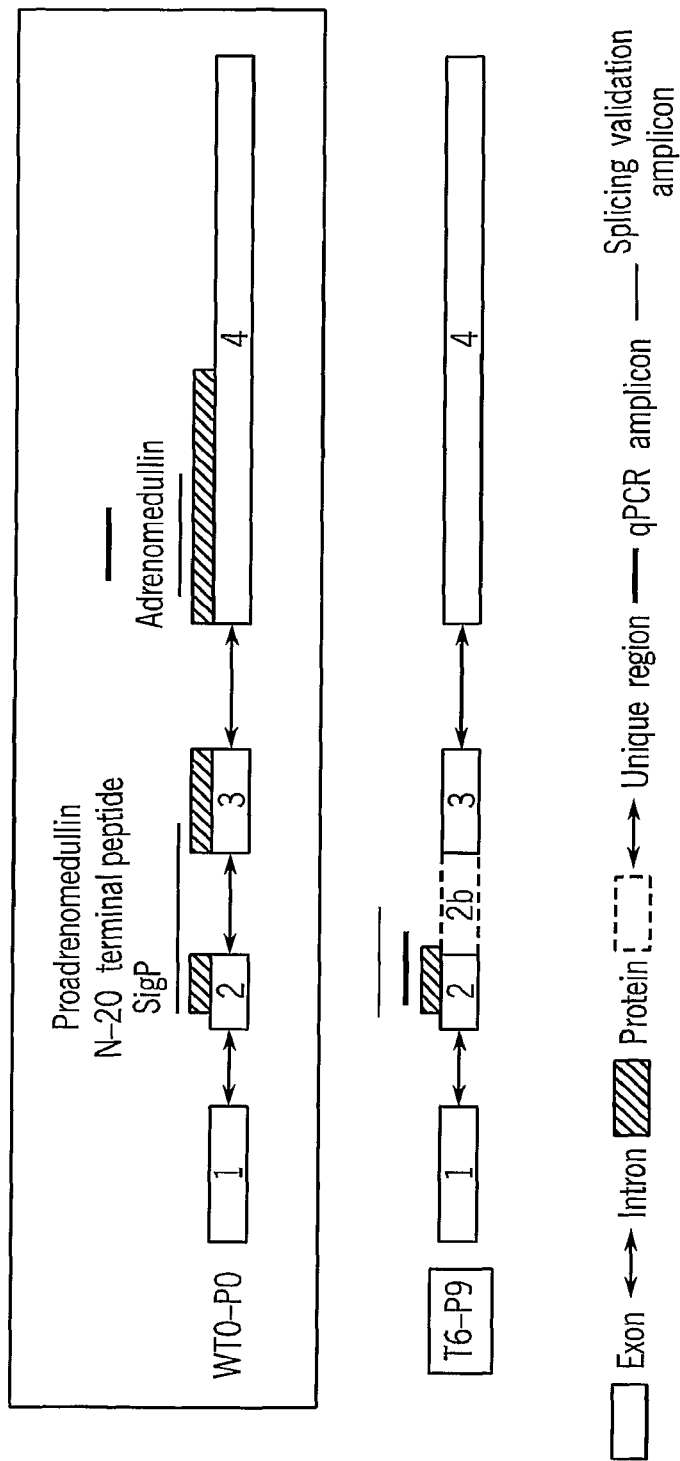
FIG. 28 shows the structure of the F05068 mRNA and protein variants. Exons are represented by white boxes, while introns are represented by two headed arrows. Proteins are shown in boxes with upper right to lower left fill. The unique regions are represented by white boxes with dashed frame.
Figure 29:
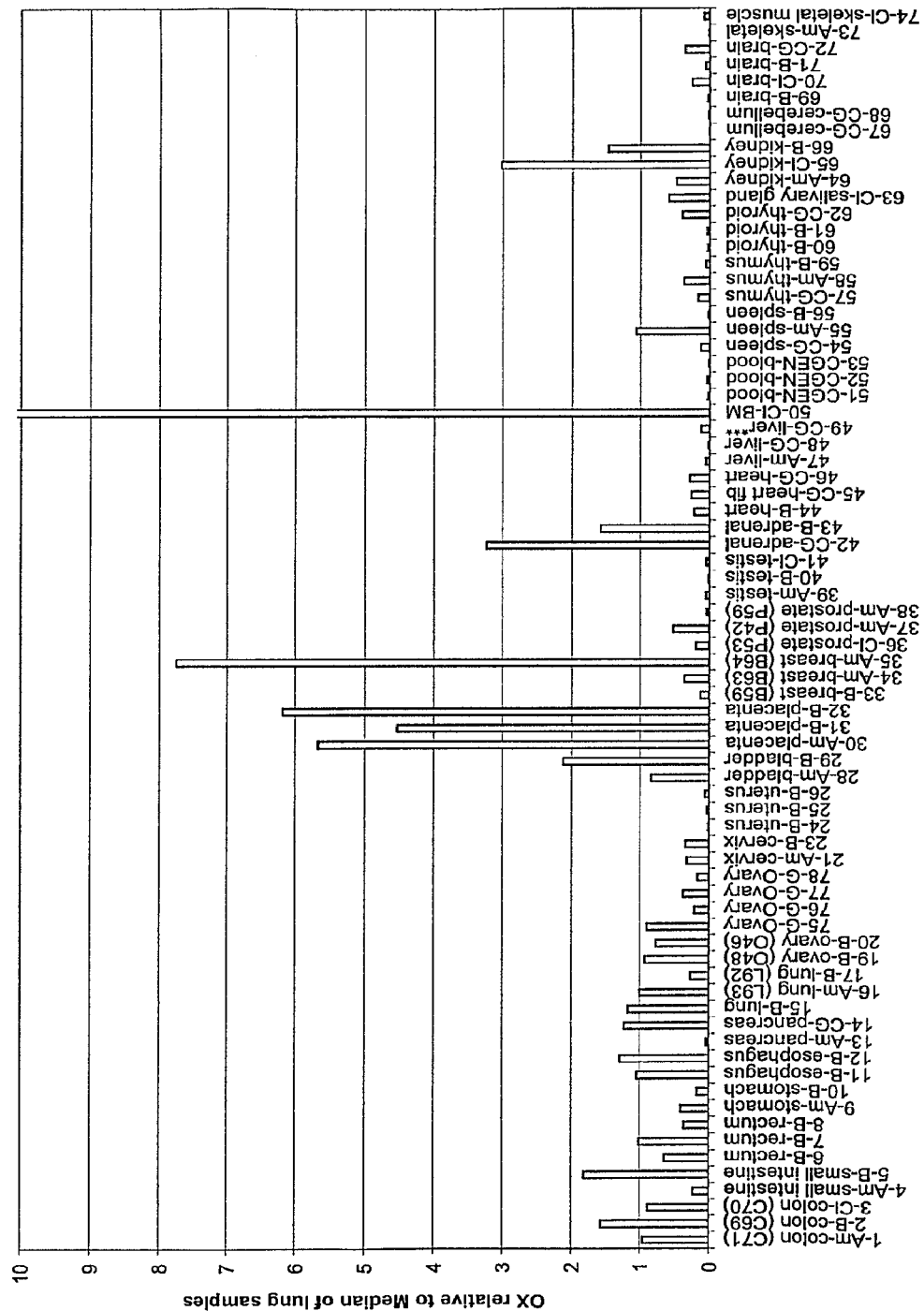
FIG. 29 shows expression of *Homo sapiens* adrenomedullin (ADM) F05068 transcripts which are detectable by amplicon as depicted in sequence name F05068 seg3-5 (SEQ ID NO: 414) in different normal tissues.

FIG. 28 shows the structure of the F05068 mRNA and protein variants. Exons are represented by white boxes, while introns are represented by two headed arrows. Proteins are shown in boxes with upper right to lower left fill. The unique regions are represented by white boxes with dashed frame. Expression of *Homo sapiens* Adrenomedullin (ADM) F05068 Transcripts which are Detectable by Amplicon as Depicted in Sequence Name F05068 seg3-5 (SEQ ID NO: 414) in Different Normal Tissues Expression of *Homo sapiens* adrenomedullin (ADM) transcripts detectable by or according to F05068 seg3-5 amplicon (SEQ ID NO: 414) and primers: F05068 seg3-5F (SEQ ID NO: 415) and F05068 seg3-5R (SEQ ID NO: 416) was measured by real time PCR. In parallel the expression of four housekeeping genes—RPL19 (GenBank Accession No. NM_000981 (SEQ ID NO:369); RPL19 (SEQ ID NO:368) amplicon), TATA box (GenBank Accession No. NM_003194 (SEQ ID NO:371); TATA (SEQ ID NO:370) amplicon), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 5), to obtain a value of relative expression of each sample relative to median of the lung samples. FIG. 29 shows expression of *Homo sapiens* adrenomedullin (ADM) F05068 transcripts which are detectable by amplicon as depicted in sequence name F05068 seg3-5 (SEQ ID NO: 414) in different normal tissues.

```
Forward primer F05068 seg3-5F (SEQ ID NO: 415):
TGGTTTCCGTCGCCCTGATG

Reverse primer F05068 seg3-5R (SEQ ID NO: 416):
CTTCGGGACCAACGGTCAGTTC

Amplicon F05068 seg3-5 (SEQ ID NO: 414):
TGGTTTCCGTCGCCCTGATGTACCTGGGTTCGCTCGCCTTCCTAGGCGCT
GACACCGCTCGGTTGGATGTCGCGTCGGAGTTTCGAAAGAAGTGAGTCCG
GGCAGCGCCTTCCCCCTTGCTGGTACCTGGCAGGCAAGGGGAACTGACCG
TTGGTCCCGAAG
```

Expression of *Homo sapiens* Adrenomedullin (ADM) F05068 Transcripts which are Detectable by Amplicon as Depicted in Sequence Name F05068 seg9 (SEQ ID NO: 417) in Normal and Cancerous Lung Tissues Expression of *Homo sapiens* adrenomedullin (ADM) transcripts detectable by or according to seg9, F05068 seg9 amplicon (SEQ ID NO: 417) and primers F05068 seg9F (SEQ ID NO: 418) and F05068 seg9R (SEQ ID NO: 419) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 3). Then the reciprocal of this ratio was calculated, to obtain a value of fold down-regulation for each sample relative to median of the normal PM samples.

Figure 30:
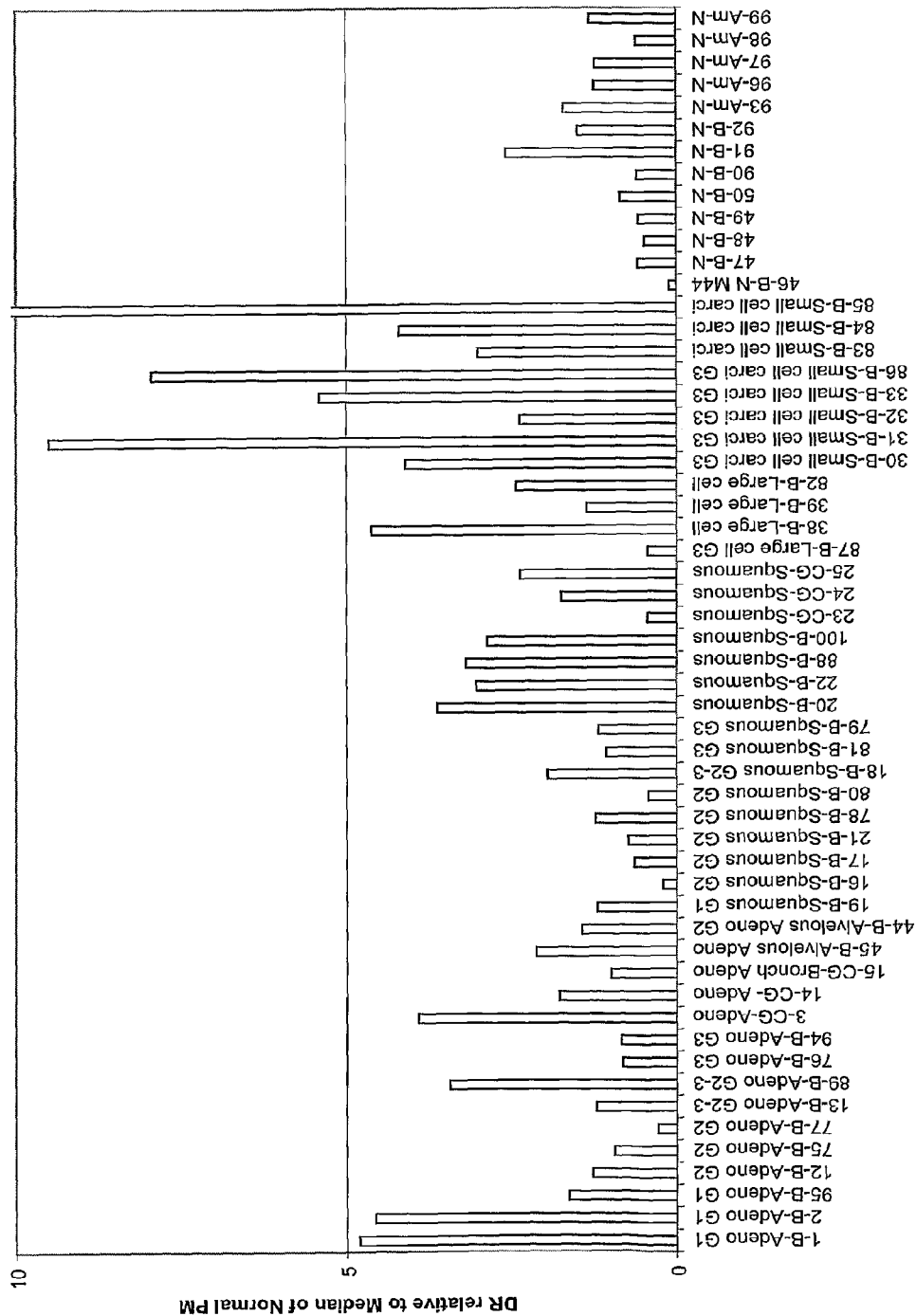
FIG. 30 is a histogram showing down regulation of the above-indicated *Homo sapiens* adrenomedullin (ADM) transcripts in cancerous lung samples relative to the normal samples (seg9)

FIG. 30 is a histogram showing down regulation of the above-indicated *Homo sapiens* adrenomedullin (ADM) transcripts in cancerous lung samples relative to the normal samples (seg9).

As is evident from FIG. 30, the expression of *Homo sapiens* adrenomedullin (ADM) transcripts detectable by the above amplicon in cancer samples was lower than in the non-cancerous samples (Sample Nos. 46-50, 90-93, 96-99 Table 3). Notably down regulation of at least 5 fold was found in 4 out of 8 small cell carcinoma samples.

Primer pairs are also optionally and preferably encompassed within the present invention; for example, for the above experiment, the following primer pair was used as a non-limiting illustrative example only of a suitable primer pair: F05068 seg9F (SEQ ID NO: 418) forward primer; and F05068 seg9R (SEQ ID NO: 419) reverse primer.

The present invention also preferably encompasses any amplicon obtained through the use of any suitable primer pair; for example, for the above experiment, the following amplicon was obtained as a non-limiting illustrative example only of a suitable amplicon: F05068 seg9 (SEQ ID NO: 417).

```
Forward primer F05068 seg9F (SEQ ID NO: 418):
ACGGGAGGGAAGGAAGGTG

Reverse primer F05068 seg9R (SEQ ID NO: 419):
CAGAGGGAGCTGGAAACTGC

Amplicon F05068 seg9 (SEQ ID NO: 417):
ACGGGAGGGAAGGAAGGTGTGCGGGAGGAGTTCTCTGTCTCCACTCCCCT
GGCCCGGGGGATCGTCGGGGCTGGACCGCAGCTCAGATGGCGCGAGCAGT
TTCCAGCTCCCTCTG
```

Expression of *Homo sapiens* Adrenomedullin (ADM) F05068 Transcripts which are Detectable by Amplicon as Depicted in Sequence Name F05068_seg9 (SEQ ID NO: 417) in Different Normal Tissues Expression of *Homo sapiens* adrenomedullin (ADM) transcripts detectable by or according to seg9-F05068_seg9 (SEQ ID NO: 417) amplicon and primers F05068_seg9F (SEQ ID NO: 418) and F05068_seg9R (SEQ ID NO: 419) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No.

Figure 31:
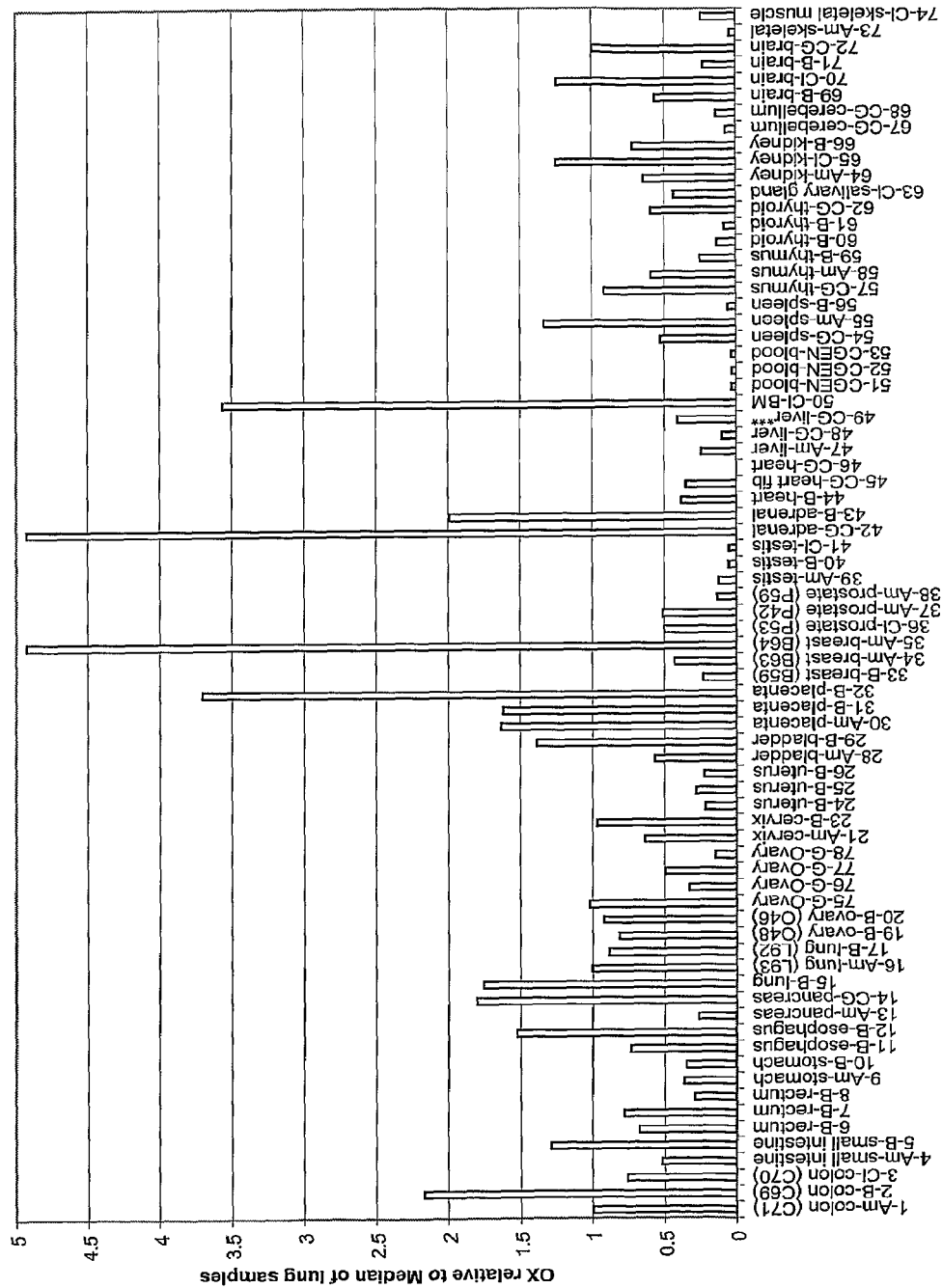
FIG. 31 shows expression of *Homo sapiens* adrenomedullin (ADM) F05068 transcripts which are detectable by amplicon as depicted in sequence name F05068_seg9 (SEQ ID NO: 417) in different normal tissues.

NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 5 above), to obtain a value of relative expression of each sample relative to median of the lung samples. FIG. 31 shows expression of Homo sapiens adrenomedullin (ADM) F05068 transcripts which are detectable by amplicon as depicted in sequence name F05068_seg9 (SEQ ID NO: 417) in different normal tissues.

```
Forward Primer (F05068_seg9F (SEQ ID NO: 418)):
ACGGGAGGGAAGGAAGGTG

Reverse Primer (F05068_seg9R (SEQ ID NO: 419)):
CAGAGGGAGCTGGAAACTGC

Amplicon (F05068_seg9 (SEQ ID NO: 417)):
ACGGGAGGGAAGGAAGGTGTGCGGGAGGAGTTCTCTGTCTCCACTCCCCT
GGCCCGGGGGATCGTCGGGGCTGGACCGCAGCTCAGATGGCGCGAGCAGT
TTCCAGCTCCCTCTG
```

Figure 32:
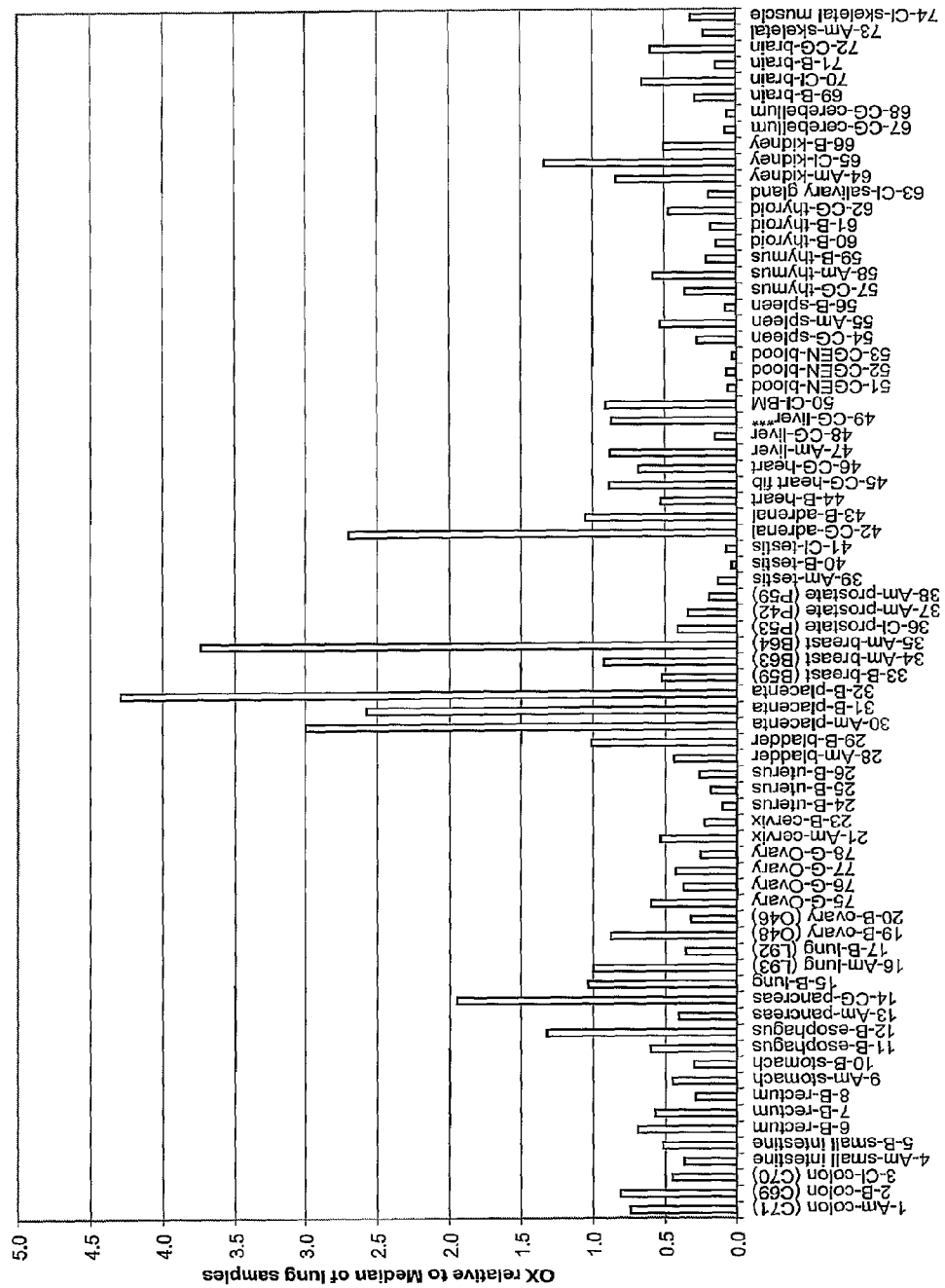
FIG. 32 shows expression of *Homo sapiens* adrenomedullin (ADM) F05068 transcripts which are detectable by amplicon as depicted in sequence name F05068_seg13_WT (SEQ ID NO:420) in different normal tissues.

Expression of Homo sapiens Adrenomedullin (ADM) F05068 Transcripts which are Detectable by Amplicon as Depicted in Sequence Name F05068_seg13_WT (SEQ ID NO:420) in Different Normal Tissues Expression of Homo sapiens adrenomedullin (ADM) transcripts detectable by or according to seg13_WT—F05068_seg13_WT (SEQ ID NO:420) amplicon and primers F05068_seg13F_WT (SEQ ID NO:421) and F05068_seg13R_WT (SEQ ID NO:422) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 5 above), to obtain a value of relative expression of each sample relative to median of the lung samples. FIG. 32 shows expression of Homo sapiens adrenomedullin (ADM) F05068 transcripts which are detectable by amplicon as depicted in sequence name F05068_seg13_WT (SEQ ID NO:420) in different normal tissues.

```
Forward Primer (F05068_seg13F_WT (SEQ ID NO:
421)):
TGCACGGTGCAGAAGCTG

Reverse Primer (F05068_seg13R_WT (SEQ ID NO:
422)):
CGGCCGTAGCCCTGG

Amplicon (F05068_seg13_WT (SEQ ID NO: 420)):
TGCACGGTGCAGAAGCTGGCACACCAGATCTACCAGTTCACAGATAAGGA
CAAGGACAACGTCGCCCCCAGGAGCAAGATCAGCCCCCAGGGCTA
CGGCCG
```

Expression of Homo sapiens Adrenomedullin (ADM) F05068 Transcripts which are Detectable by Amplicon as Depicted in Sequence Name F05068 seg3-5 (SEQ ID NO: 414) in Normal and Cancerous Lung Tissues Expression of Homo sapiens adrenomedullin (ADM) transcripts detectable by or according to seg3-5, F05068 seg3-5 (SEQ ID NO: 414) amplicon and primers F05068 seg3-5F (SEQ ID NO: 415) and F05068 seg3-5R (SEQ ID NO: 416) was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), Ubiquitin (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal postmortem (PM) samples (Sample Nos. 47-50, 90-93, 96-99, Table 3).

Figure 33:
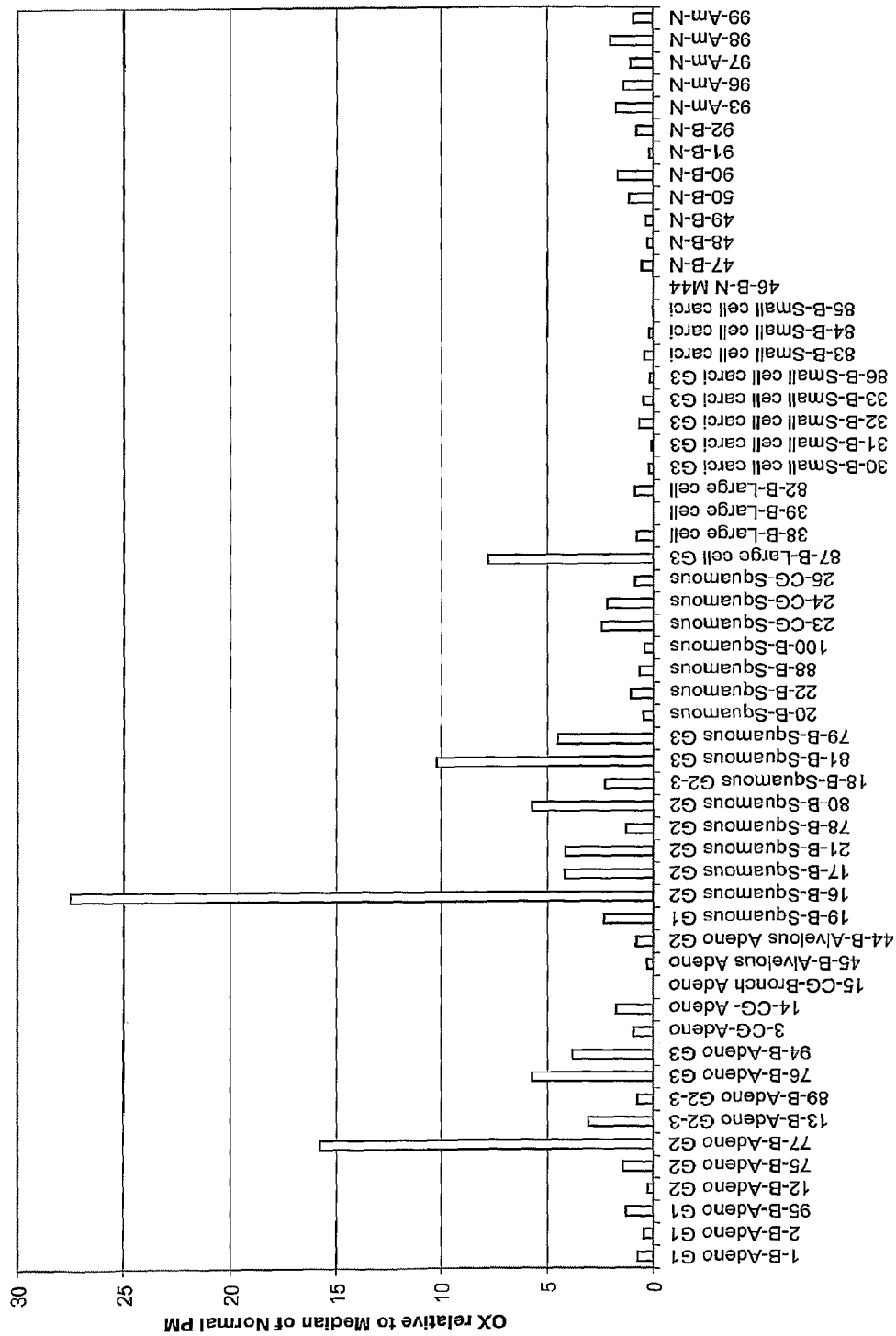
FIG. 33 is a histogram showing the expression of *Homo sapiens* adrenomedullin (ADM) F05068 transcripts which are detectable by amplicon as depicted in sequence name F05068_ seg3-5 (SEQ ID NO: 414) in normal and cancerous Lung tissues.

FIG. 33 is a histogram showing over expression of the above-indicated Homo sapiens adrenomedullin (ADM) transcripts in cancerous lung samples relative to the normal samples.

As is evident from FIG. 33, the expression of Homo sapiens adrenomedullin (ADM) transcripts detectable by the above amplicon was higher in several cancer samples than in the non-cancerous samples (Sample Nos. 46-50, 90-93, 96-99 Table 3). Notably over expression of at least 5 fold was found in 6 out of 35 non-small cells carcinoma samples.

Primer pairs are also optionally and preferably encompassed within the present invention; for example, for the above experiment, the following primer pair was used as a non-limiting illustrative example only of a suitable primer pair: F05068 seg seg3-5F (SEQ ID NO: 415) forward primer; and F05068 seg seg3-5R (SEQ ID NO: 416) reverse primer.

The present invention also preferably encompasses any amplicon obtained through the use of any suitable primer pair; for example, for the above experiment, the following amplicon was obtained as a non-limiting illustrative example only of a suitable amplicon: F05068 seg3-5 (SEQ ID NO: 414).

```
Forward primer F05068 seg3-5F (SEQ ID NO:
415):
TGGTTTCCGTCGCCCTGATG

Reverse primer F05068 seg3-5R (SEQ ID NO:
416):
CTTCGGGACCAACGGTCAGTTC

Amplicon F05068 seg3-5 SEQ ID NO: 414):
TGGTTTCCGTCGCCCTGATGTACCTGGGTTCGCTCGCCTTCCTAGGCGCT
GACACCGCTCGGTTGGATGTCGCGTCGGAGTTTCGAAAGAAGTGAGTCCG
GGCAGCGCCTTCCCCCTTGCTGGTACCTGGCAGGCAAGGGGAACTGACCG
TTGGTCCCGAAG
```

Homo sapiens adrenomedullin (ADM) F05068 transcripts which are detectable by amplicon as depicted in sequence name F05068_seg13_WT (SEQ ID NO:420) and primers F05068_seg13_WT-F (SEQ ID NO: 421) and F05068_seg13_WT-R (SEQ ID NO: 422) did not show any differential expression in one experiment carried out with lung cancer panel.

*Homo sapiens* adrenomedullin (ADM) F05068 transcripts which are detectable by amplicon as depicted in sequence name F05068_seg9 (SEQ ID NO: 417) and primers F05068_seg9-F (SEQ ID NO: 418) and F05068_seg9-R (SEQ ID NO: 419) did not show any differential expression in one experiment carried out with breast cancer panel.

Description for Cluster HUMIL10

Cluster HUMIL10 features 4 transcript(s) and 15 segment(s) of interest, the names for which are given in Tables 202 and 203, respectively. The selected protein variants are given in table 204.

TABLE 202

Transcripts of interest
Transcript Name

HUMIL10_T5 (SEQ ID NO: 211)

HUMIL10_T6 (SEQ ID NO: 212)

HUMIL10_T8 (SEQ ID NO: 213)

HUMIL10_T10 (SEQ ID NO: 214)

TABLE 203

Segments of interest
Segment Name

HUMIL10_N0 (SEQ ID NO: 220)

HUMIL10_N5 (SEQ ID NO: 223)

HUMIL10_N6 (SEQ ID NO: 224)

HUMIL10_N10 (SEQ ID NO: 225)

HUMIL10_N14 (SEQ ID NO: 227)

HUMIL10_N16 (SEQ ID NO: 229)

HUMIL10_N19 (SEQ ID NO: 232)

HUMIL10_N1 (SEQ ID NO: 221)

HUMIL10_N3 (SEQ ID NO: 222)

HUMIL10_N11 (SEQ ID NO: 226)

HUMIL10_N15 (SEQ ID NO: 228)

HUMIL10_N17 (SEQ ID NO: 230)

HUMIL10_N18 (SEQ ID NO: 231)

HUMIL10_N20 (SEQ ID NO: 233)

HUMIL10_N21 (SEQ ID NO: 234)

TABLE 204

Proteins of interest

| Protein Name | Corresponding Transcript(s) |
| --- | --- |
| HUMIL10_P6 (SEQ ID NO: 215) | HUMIL10_T6 (SEQ ID NO: 212) |
| HUMIL10_P9 (SEQ ID NO: 216) | HUMIL10_T10 (SEQ ID NO: 214) |
| HUMIL10_P10 (SEQ ID NO: 217) | HUMIL10_T5 (SEQ ID NO: 211) |

TABLE 204-continued

Proteins of interest

| Protein Name | Corresponding Transcript(s) |
| --- | --- |
| HUMIL10_P12 (SEQ ID NO: 218) | HUMIL10_T8 (SEQ ID NO: 213) |
| HUMIL10_P13 (SEQ ID NO: 219) | HUMIL10_T10 (SEQ ID NO: 214) |

These sequences are variants of the known protein Interleukin-10 precursor (SwissProt accession identifier IL10_HUMAN (SEQ ID NO:423); known also according to the synonyms IL-10; Cytokine synthesis inhibitory factor; CSIF), referred to herein as the previously known protein.

Protein Interleukin-10 precursor is known or believed to have the following function(s): Inhibits the synthesis of a number of cytokines, including IFN-gamma, IL-2, IL-3, TNF and GM-CSF produced by activated macrophages and by helper T cells. The sequence for protein Interleukin-10 precursor is given at the end of the application, as "Interleukin-10 precursor amino acid sequence". Known polymorphisms for this sequence are as shown in Table 205.

TABLE 205

Amino acid mutations for Known Protein

| SNP position(s) on amino acid sequence | Comment |
| --- | --- |
| 15 | G -> R (in CD; decreases secretion thereby reducing the anti-inflammatory effect). /FTId = VAR_015883 |

Protein Interleukin-10 precursor localization is believed to be Secreted.

The previously known protein also has the following indication(s) and/or potential therapeutic use(s): Inflammation, general; Inflammatory bowel disease; Pain, neuropathic. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Interleukin 10 agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Analgesic, other; Anti-inflammatory; Cytokine; GI inflammatory/bowel disorders; Recombinant interleukin.

The following GO Annotation(s) apply to the previously known protein. The following annotation(s) were found: anti-apoptosis; B-cell differentiation; B-cell proliferation; cell-cell signaling; cytoplasmic sequestering of NF-kappaB; hemopoiesis; immune cell chemotaxis; negative regulation of interferon-alpha biosynthesis; negative regulation of interferon-gamma biosynthesis; negative regulation of MHC class II biosynthesis; negative regulation of nitric oxide biosynthesis; negative regulation of T-cell proliferation; regulation of isotype switching; T-helper 2 type immune response, which are annotation(s) related to Biological Process; interleukin-10 receptor binding, which are annotation(s) related to Molecular Function; and extracellular region, which are annotation(s) related to Cellular Component.

The GO assignment relies on information from one or more of the SwissProt/TremBl Protein knowledgebase or Locuslink.

IL-10 is a cytokine that has pleiotropic effects in immunoregulation and inflammation. It down-regulates the expression of Th1 cytokines, MHC class II Ags, and co-stimulatory molecules on macrophages. It also enhances B cell survival, proliferation, and antibody production. Therefore any condition featuring an imbalance between Th1 to Th2 is relevant (such as Crohn's disease for example, although of course many other such diseases could be included).

TABLE 206

| Dx field | Explanation | Ref |
|---|---|---|
| IL10 alone or the ratio of IL-10 to IL6 can serve as marker for acute pancreatitis severity. | The IL-10/IL-6 ratio was significantly lower in patients with severe acute pancreatitis, suggesting that a proinflammatory response was predominant in these patients | Hepatogastroenterology. 2005 July-August; 52(64): 990-4. Gut. 1999 December; 45(6): 895-9. Pancreas. 1999 May; 18(4): 371-7. |
| Differential diagnosis of psoriatic arthritis (PsA) to rheumatoid arthritis (RA) and osteoarthritis (OA), in synovial fluid. | Both the frequency and the concentrations of cytokines (IL10 among others) were lower in PsA SFs than in RA SFs, while OA SFs generally lacked any detectable T cell cytokines altogether. | Ann Rheum Dis 1998; 57: 691-693 (November) |
| Differentiation between systemic sclerosis (SSc) interstitial lung disease to idiopathic usual interstitial pneumonia in bronchoalveolar lavage fluid. Might be used in combination with IL-12 and/or MCP-1 | levels of the anti-inflammatory IL10 were higher in SSc-ILD than in controls. | |
| Detection and outcome prediction of cardiovascular disease in people >65. alone or in combination with IL6 and or TNF alpha | IL-6, TNFalpha and IL-10 levels have been shown to predict cardiovascular outcomes. | Cardiovasc Res. 2005 May 1; 66(2): 265-75. Epub 2005 January 28. |

As noted above, cluster HUMIL10 features 4 transcript(s), which were listed in Table 202 above. These transcript(s) encode for protein(s) which are variant(s) of protein Interleukin-10 precursor. A description of each variant protein according to the present invention is now provided.

Variant protein HUMIL10_P6 (SEQ ID NO:215) according to the present invention has an amino acid sequence as given at the end of the application; it is encoded by transcript(s) HUMIL10_T6 (SEQ ID NO:212). An alignment is given to the known protein (Interleukin-10 precursor) in the alignment table on the attached CD-ROM. A brief description of the relationship of the variant protein according to the present invention to each such aligned protein is as follows:
1. Comparison report between HUMIL10_P6 (SEQ ID NO:215) and IL10_HUMAN (SEQ ID NO:423):

A. An isolated chimeric polypeptide as set forth in HUMIL10_P6 (SEQ ID NO:215), comprising an amino acid sequence being at least 90% homologous to MIQFYLEEVMPQAENQDPDIKAHVNSLGENLKTLRLRLRRCHRFLPCENKSKAVEQVKNAFNKLQEKGIYKAMSEFDIFINYIEAYMTMKIRN corresponding to amino acids 86-178 of IL10_HUMAN (SEQ ID NO:423), which also corresponds to amino acids 1-93 of HUMIL10_P6 (SEQ ID NO:215).
2. Comparison report between HUMIL10_P6 (SEQ ID NO:215) and Q6FGS9_HUMAN (SEQ ID NO: 545):

A. An isolated chimeric polypeptide as set forth in HUMIL10_P6 (SEQ ID NO:215), comprising a first amino acid sequence being at least 90% homologous to MIQFYLEEVMPQAENQDPDIKAHVNSLGENLKTLRLRLRRC corresponding to amino acids 86-126 of Q6FGS9_HUMAN (SEQ ID NO: 545), which also corresponds to amino acids 1-41 of HUMIL10_P6 (SEQ ID NO:215), a bridging amino acid H corresponding to amino acid 42 of HUMIL10_P6 (SEQ ID NO:215), and a second amino acid sequence being at least 90% homologous to RFLPCENKSKAVEQVKNAFNKLQEKGIYKAMSEFDIFINYIEAYMTMKIRN corresponding to amino acids 128-178 of Q6FGS9_HUMAN (SEQ ID NO: 545), which also corresponds to amino acids 43-93 of HUMIL10_P6 (SEQ ID NO:215), wherein said first amino acid sequence, bridging amino acid and second amino acid sequence are contiguous and in a sequential order.

The location of the variant protein was determined according to results from a number of different software programs and analyses, including analyses from SignalP and other specialized programs. The variant protein is intracellularly.

Variant protein HUMIL10_P6 (SEQ ID NO:215) also has the following non-silent SNPs (Single Nucleotide Polymorphisms) as listed in Table 207, (given according to their position(s) on the amino acid sequence, with the alternative amino acid(s) listed; the presence of known SNPs in variant protein HUMIL10_P6 (SEQ ID NO:215) sequence provides support for the deduced sequence of this variant protein according to the present invention).

TABLE 207

| Amino acid mutations | |
|---|---|
| SNP position(s) on amino acid sequence | Alternative amino acid(s) |
| 26 | S -> |

The glycosylation sites of variant protein HUMIL10_P6 (SEQ ID NO:215), as compared to the known protein Interleukin-10 precursor, are described in Table 208 (given according to their position(s) on the amino acid sequence in the first column; the second column indicates whether the glycosylation site is present in the variant protein; and the last column indicates whether the position is different on the variant protein).

TABLE 208

| Glycosylation site(s) | | |
|---|---|---|
| Position(s) on known amino acid sequence | Present in variant protein? | Position(s) on variant protein |
| 134 | Yes | 49 |

Variant protein HUMIL10_P6 (SEQ ID NO:215) is encoded by the following transcript(s): HUMIL10_T6 (SEQ ID NO:212), for which the coding portion starts at position 171 and ends at position 449. The transcript also has the following SNPs as listed in Table 209 (given according to their position on the nucleotide sequence, with the alternative nucleic acid listed; the presence of known SNPs in variant protein HUMIL10_P6 (SEQ ID NO:215) sequence provides support for the deduced sequence of this variant protein according to the present invention).

TABLE 209

| Nucleic acid SNPs | |
|---|---|
| Polymorphism | SNP position(s) on nucleotide sequence |
| C -> | 247 |
| C -> T | 260, 569, 1213 |
| T -> C | 488 |
| A -> G | 643, 904, 1404 |
| A -> | 772 |
| A -> T | 797 |
| G -> A | 970, 1067 |

Variant protein HUMIL10_P9 (SEQ ID NO:216) according to the present invention has an amino acid sequence as given at the end of the application; it is encoded by transcript(s) HUMIL10_T10 (SEQ ID NO:214). An alignment is given to the known protein (Interleukin-10 precursor) in the alignment table on the attached CD-ROM. A brief description of the relationship of the variant protein according to the present invention to each such aligned protein is as follows:

1. Comparison report between HUMIL10_P9 (SEQ ID NO:216) and IL10_HUMAN (SEQ ID NO:423):

A. An isolated chimeric polypeptide as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTFSFLPQ (SEQ ID NO: 584) corresponding to amino acids 1-28 of HUMIL10_P9 (SEQ ID NO:216), and a second amino acid sequence being at least 90% homologous to HRFLPCENK-SKAVEQVKNAFNKLQEKGIYKAMSEFDI-FINYIEAYMTMKIRN corresponding to amino acids 127-178 of IL10_HUMAN (SEQ ID NO:423), which also corresponds to amino acids 29-80 of HUMIL10_P9 (SEQ ID NO:216), wherein said first amino acid sequence and second amino acid sequence are contiguous and in a sequential order.

B. An isolated polypeptide encoding for a head of HUMIL10_P9 (SEQ ID NO:216), comprising a polypeptide being at least 70%, optionally at least about 80%, preferably at least about 85%, more preferably at least about 90% and most preferably at least about 95% homologous to the sequence MMPPACPLSVMDMELEARITNTFSFLPQ (SEQ ID NO: 584) of HUMIL10_P9 (SEQ ID NO:216).

2. Comparison report between HUMIL10_P9 (SEQ ID NO:216) and Q71UZ1_HUMAN (SEQ ID NO: 542):

A. An isolated chimeric polypeptide as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTF-SFLPQ (SEQ ID NO: 584) corresponding to amino acids 1-28 of HUMIL10_P9 (SEQ ID NO:216), and a second amino acid sequence being at least 90% homologous to HRFLPCENK-SKAVEQVKNAFNKLQEKGIYKAMSEFDI-FINYIEAYMTMKIRN corresponding to amino acids 109-160 of Q71UZ1_HUMAN (SEQ ID NO: 542), which also corresponds to amino acids 29-80 of HUMIL10_P9 (SEQ ID NO:216), wherein said first amino acid sequence and second amino acid sequence are contiguous and in a sequential order.

3. Comparison report between HUMIL10_P9 (SEQ ID NO:216) and Q6FGS9_HUMAN (SEQ ID NO: 545):

A. An isolated chimeric polypeptide as set forth in HUMIL10_P9 (SEQ ID NO:216), comprising a first amino acid sequence being at least 70%, optionally at least 80%, preferably at least 85%, more preferably at least 90% and most preferably at least 95%, homologous to a polypeptide having the sequence MMPPACPLSVMDMELEARITNTF-SFLPQH (SEQ ID NO: 585) corresponding to amino acids 1-29 of HUMIL10_P9 (SEQ ID NO:216), and a second amino acid sequence being at least 90% homologous to RFLPCENK-SKAVEQVKNAFNKLQEKGIYKAMSEFDI-FINYIEAYMTMKIRN corresponding to amino acids 128-178 of Q6FGS9_HUMAN (SEQ ID NO: 545), which also corresponds to amino acids 30-80 of HUMIL10_P9 (SEQ ID NO:216), wherein said first amino acid sequence and second amino acid sequence are contiguous and in a sequential order.

B. An isolated polypeptide encoding for a head of HUMIL10_P9 (SEQ ID NO:216), comprising a polypeptide being at least 70%, optionally at least about 80%, preferably at least about 85%, more preferably at least about 90% and most preferably at least about 95% homologous to the sequence MMPPACPLSVMDMELEARITNTFSFLPQH (SEQ ID NO: 585) of HUMIL10_P9 (SEQ ID NO:216).

The location of the variant protein was determined according to results from a number of different software programs and analyses, including analyses from SignalP and other specialized programs. The variant protein is intracellularly.

The glycosylation sites of variant protein HUMIL10_P9 (SEQ ID NO:216), as compared to the known protein Interleukin-10 precursor, are described in Table 210 (given according to their position(s) on the amino acid sequence in the first column; the second column indicates whether the glycosylation site is present in the variant protein; and the last column indicates whether the position is different on the variant protein).

TABLE 210

| Glycosylation site(s) | | |
|---|---|---|
| Position(s) on known amino acid sequence | Present in variant protein? | Position(s) on variant protein |
| 134 | Yes | 36 |

Variant protein HUMIL10_P9 (SEQ ID NO:216) is encoded by the following transcript(s): HUMIL10_T10 (SEQ ID NO:214), for which the coding portion starts at position 182 and ends at position 421. The transcript also has the following SNPs as listed in Table 211 (given according to their position on the nucleotide sequence, with the alternative nucleic acid listed; the presence of known SNPs in variant protein HUMIL10_P9 (SEQ ID NO:216) sequence provides support for the deduced sequence of this variant protein according to the present invention).

TABLE 211

| Nucleic acid SNPs | |
|---|---|
| Polymorphism | SNP position(s) on nucleotide sequence |
| T -> G | 95 |
| G -> A | 140, 942, 1039 |
| A -> G | 154, 615, 876, 1376 |
| T -> C | 208, 460 |
| C -> T | 541, 1185 |
| A -> | 744 |
| A -> T | 769 |

Variant protein HUMIL10_P10 (SEQ ID NO:217) according to the present invention has an amino acid sequence as given at the end of the application; it is encoded by transcript(s) HUMIL10 (SEQ ID NO:211). An alignment is given to the known protein (Interleukin-10 precursor) in the alignment table on the attached CD-ROM. A brief description of the relationship of the variant protein according to the present invention to each such aligned protein is as follows:

1. Comparison report between HUMIL10_P10 (SEQ ID NO:217) and IL10_HUMAN (SEQ ID NO:423):

A. An isolated chimeric polypeptide as set forth in HUMIL10_P10 (SEQ ID NO:217), comprising a first amino acid sequence being at least 90% homologous to MHSSAL-LCCLVLLTGVRASPGQGTQSENSCTHF-PGNLPNMLRDLRDAFSR corresponding to amino acids 1-50 of IL10_HUMAN (SEQ ID NO:423), which also corresponds to amino acids 1-50 of HUMIL10_P10 (SEQ ID NO:217), and a second amino acid sequence being at least 90% homologous to QMKDQLDNLLLKESLLED-FKGYLGCQALSEMIQFYLEEVMPQAEN-QDPDIKAHVNSLGENLKTLRLRLRRCHR FLPCENK-SKAVEQVKNAFNKLQEKGIYKAMSEFDIFINYIEAY-MTMKIRN (SEQ ID NO: 491) corresponding to amino acids 56-178 of IL10_HUMAN (SEQ ID NO:423), which also corresponds to amino acids 51-173 of HUMIL10_P10 (SEQ ID NO:217), wherein said first amino acid sequence and second amino acid sequence are contiguous and in a sequential order.

B. An isolated chimeric polypeptide encoding for an edge portion of HUMIL10_P10 (SEQ ID NO:217), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RQ, having a structure as follows: a sequence starting from any of amino acid numbers 50-x to 50; and ending at any of amino acid numbers 51+((n-2)-x), in which x varies from 0 to n-2.

2. Comparison report between HUMIL10_P10 (SEQ ID NO:217) and Q6FGS9_HUMAN (SEQ ID NO:545):

A. An isolated chimeric polypeptide as set forth in HUMIL10_P10 (SEQ ID NO:217), comprising a first amino acid sequence being at least 90% homologous to MHSSAL-LCCLVLLTGVRASPGQGTQSENSCTHF-PGNLPNMLRDLRDAFSR corresponding to amino acids 1-50 of Q6FGS9_HUMAN (SEQ ID NO: 545), which also corresponds to amino acids 1-50 of HUMIL10_P10 (SEQ ID NO:217), a second amino acid sequence being at least 90% homologous to QMKDQLDNLLLKESLLEDFKGYLGC-QALSEMIQFYLEEVMPQAENQDPDIKAH-VNSLGENLKTLRLRLRRC corresponding to amino acids 56-126 of Q6FGS9_HUMAN (SEQ ID NO: 545), which also corresponds to amino acids 51-121 of HUMIL10_P10 (SEQ ID NO:217), a bridging amino acid H corresponding to amino acid 122 of HUMIL10_P10 (SEQ ID NO:217), and a third amino acid sequence being at least 90% homologous to RFLPCENK-SKAVEQVKNAFNKLQEKGIYKAMSEFDI-FINYIEAYMTMKIRN corresponding to amino acids 128-178 of Q6FGS9_HUMAN (SEQ ID NO: 545), which also corresponds to amino acids 123-173 of HUMIL10_P10 (SEQ ID NO:217), wherein said first amino acid sequence, second amino acid sequence, bridging amino acid and third amino acid sequence are contiguous and in a sequential order.

B. An isolated chimeric polypeptide encoding for an edge portion of HUMIL10_P10 (SEQ ID NO:217), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RQ, having a structure as follows: a sequence starting from any of amino acid numbers 50-x to 50; and ending at any of amino acid numbers 51+((n-2)-x), in which x varies from 0 to n-2.

3. Comparison report between HUMIL10_P10 (SEQ ID NO:217) and Q71UZ1_HUMAN (SEQ ID NO: 542):

A. An isolated chimeric polypeptide as set forth in HUMIL10_P10 (SEQ ID NO:217), comprising a first amino acid sequence being at least 70%, optionally at least 80%, preferably at least 85%, more preferably at least 90% and most preferably at least 95%, homologous to a polypeptide having the sequence MHSSALLCCLVLLTGVRA (SEQ ID NO: 586) corresponding to amino acids 1-18 of HUMIL10_P10 (SEQ ID NO:217), a second amino acid sequence being at least 90% homologous to SPGQGTQSEN-SCTHFPGNLPNMLRDLRDAFSR corresponding to amino acids 1-32 of Q71UZ1_HUMAN (SEQ ID NO: 542), which also corresponds to amino acids 19-50 of HUMIL10_P10 (SEQ ID NO:217), and a third amino acid sequence being at least 90% homologous to QMKDQLDNLLLKESLLED-FKGYLGCQALSEMIQFYLEEVMPQAEN-QDPDIKAHVNSLGENLKTLRLRLRRCHR FLPCENK-SKAVEQVKNAFNKLQEKGIYKAMSEFDIFINYIEAY-MTMKIRN (SEQ ID NO: 491) corresponding to amino acids 38-160 of Q71UZ1_HUMAN (SEQ ID NO: 542), which also corresponds to amino acids 51-173 of HUMIL10_P10 (SEQ ID NO:217), wherein said first amino acid sequence, second amino acid sequence and third amino acid sequence are contiguous and in a sequential order.

B. An isolated polypeptide encoding for a head of HUMIL10_P10 (SEQ ID NO:217), comprising a polypeptide being at least 70%, optionally at least about 80%, preferably at least about 85%, more preferably at least about 90% and most preferably at least about 95% homologous to the sequence MHSSALLCCLVLLTGVRA (SEQ ID NO: 586) of HUMIL10_P10 (SEQ ID NO:217).

C. An isolated chimeric polypeptide encoding for an edge portion of HUMIL10_P10 (SEQ ID NO:217), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RQ, having a structure as follows: a sequence starting from any of amino acid numbers 50−x to 50; and ending at any of amino acid numbers 51+((n−2)−x), in which x varies from 0 to n−2.

6. Comparison report between HUMIL10_P10 (SEQ ID NO:217) and Q6LBF4_HUMAN (SEQ ID NO: 546):

A. An isolated chimeric polypeptide as set forth in HUMIL10_P10 (SEQ ID NO:217), comprising a first amino acid sequence being at least 90% homologous to MHSSAL-LCCLVLLTGVRASPGQGTQSENSCTHF-PGNLPNMLRDLRDAFSR corresponding to amino acids 1-50 of Q6LBF4_HUMAN (SEQ ID NO: 546), which also corresponds to amino acids 1-50 of HUMIL10_P10 (SEQ ID NO:217), and a second amino acid sequence being at least 70%, optionally at least 80%, preferably at least 85%, more preferably at least 90% and most preferably at least 95% homologous to a polypeptide having the sequence QMKDQLDNLLLKESLLEDFKGYLGC-QALSEMIQFYLEEVMPQAENQDPDIKAH-VNSLGENLKTLRLRLRRCHR FLPCENK-SKAVEQVKNAFNKLQEKGIYKAMSEFDIFINYIEAY-MTMKIRN (SEQ ID NO: 491) corresponding to amino acids 51-173 of HUMIL10_P10 (SEQ ID NO:217), wherein said first amino acid sequence and second amino acid sequence are contiguous and in a sequential order.

B. An isolated polypeptide encoding for an edge portion of HUMIL10_P10 (SEQ ID NO:217), comprising an amino acid sequence being at least 70%, optionally at least about 80%, preferably at least about 85%, more preferably at least about 90% and most preferably at least about 95% homologous to the sequence QMKDQLDNLLLKESLLED-FKGYLGCQALSEMIQFYLEEVMPQAEN-QDPDIKAHVNSLGENLKTLRLRLRRCHR FLPCENK-SKAVEQVKNAFNKLQEKGIYKAMSEFDI-FINYIEAYMTMKIRN (SEQ ID NO: 491) of HUMIL10_P10 (SEQ ID NO:217).

The location of the variant protein was determined according to results from a number of different software programs and analyses, including analyses from SignalP and other specialized programs. The variant protein is secreted.

Variant protein HUMIL10_P10 (SEQ ID NO:217) also has the following non-silent SNPs (Single Nucleotide Polymorphisms) as listed in Table 212, (given according to their position(s) on the amino acid sequence, with the alternative amino acid(s) listed; the presence of known SNPs in variant protein HUMIL10_P10 (SEQ ID NO:217) sequence provides support for the deduced sequence of this variant protein according to the present invention).

TABLE 212

| Amino acid mutations | |
|---|---|
| SNP position(s) on amino acid sequence | Alternative amino acid(s) |
| 106 | S -> |

The glycosylation sites of variant protein HUMIL10_P10 (SEQ ID NO:217), as compared to the known protein Interleukin-10 precursor, are described in Table 213 (given according to their position(s) on the amino acid sequence in the first column; the second column indicates whether the glycosylation site is present in the variant protein; and the last column indicates whether the position is different on the variant protein).

TABLE 213

| Glycosylation site(s) | | |
|---|---|---|
| Position(s) on known amino acid sequence | Present in variant protein? | Position(s) on variant protein |
| 134 | Yes | 129 |

Variant protein HUMIL10_P10 (SEQ ID NO:217) is encoded by the following transcript(s): HUMIL10_T5 (SEQ ID NO:211), for which the coding portion starts at position 60 and ends at position 578. The transcript also has the following SNPs as listed in Table 214 (given according to their position on the nucleotide sequence, with the alternative nucleic acid listed; the presence of known SNPs in variant protein HUMIL10_P10 (SEQ ID NO:217) sequence provides support for the deduced sequence of this variant protein according to the present invention).

TABLE 214

| Nucleic acid SNPs | |
|---|---|
| Polymorphism | SNP position(s) on nucleotide sequence |
| C -> | 376 |
| C -> T | 389, 698, 1342 |
| T -> C | 617 |
| A -> G | 772, 1033, 1533 |
| A -> | 901 |
| A -> T | 926 |
| G -> A | 1099, 1196 |

Variant protein HUMIL10_P12 (SEQ ID NO:218) according to the present invention has an amino acid sequence as given at the end of the application; it is encoded by transcript(s) HUMIL10_P10 (SEQ ID NO:213). An alignment is given to the known protein (Interleukin-10 precursor) in the alignment table on the attached CD-ROM. A brief description of the relationship of the variant protein according to the present invention to each such aligned protein is as follows:

1. Comparison report between HUMIL10_P12 (SEQ ID NO:218) and IL10_HUMAN (SEQ ID NO:423):

A. An isolated chimeric polypeptide as set forth in HUMIL10_P12 (SEQ ID NO:218), comprising a first amino acid sequence being at least 90% homologous to MHSSAL-LCCLVLLTGVRASPGQGTQSENSCTHF-PGNLPNMLRDLRDAFSRVKT-FFQMKDQLDNLLLKESLLED FKGYLGCQALSEMIQFYLEEVMPQAEN-QDPDIKAHVNSLGENLKTLRLRLRRC corresponding to amino acids 1-126 of IL10_HUMAN (SEQ ID NO:423), which also corresponds to amino acids 1-126 of HUMIL10_P12 (SEQ ID NO:218), and a second amino acid sequence being at least 90% homologous to LQEKGIYKAMSEFDIFINYIEAYMTMKIRN corresponding to amino acids 149-178 of IL10_HUMAN (SEQ ID NO:423), which also corresponds to amino acids 127-156 of HUMIL10_P12 (SEQ ID NO:218), wherein said first amino acid sequence and second amino acid sequence are contiguous and in a sequential order.

B. An isolated chimeric polypeptide encoding for an edge portion of HUMIL10_P12 (SEQ ID NO:218), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CL, having a structure as follows: a sequence starting from any of amino acid numbers 126-x to 126; and ending at any of amino acid numbers 127+((n-2)-x), in which x varies from 0 to n-2.

5. Comparison report between HUMIL10_P12 (SEQ ID NO:218) and Q71UZ1_HUMAN (SEQ ID NO: 542):

A. An isolated chimeric polypeptide as set forth in HUMIL10_P12 (SEQ ID NO:218), comprising a first amino acid sequence being at least 70%, optionally at least 80%, preferably at least 85%, more preferably at least 90% and most preferably at least 95%, homologous to a polypeptide having the sequence MHSSALLCCLVLLTGVRA (SEQ ID NO: 586) corresponding to amino acids 1-18 of HUMIL10_P12 (SEQ ID NO:218), a second amino acid sequence being at least 90% homologous to SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRC corresponding to amino acids 1-108 of Q71UZ1_HUMAN (SEQ ID NO: 542), which also corresponds to amino acids 19-126 of HUMIL10_P12 (SEQ ID NO:218), and a third amino acid sequence being at least 90% homologous to LQEKGIYKAMSEFDIFINYIEAYMTMKIRN corresponding to amino acids 131-160 of Q71UZ1_HUMAN (SEQ ID NO: 542), which also corresponds to amino acids 127-156 of HUMIL10_P12 (SEQ ID NO:218), wherein said first amino acid sequence, second amino acid sequence and third amino acid sequence are contiguous and in a sequential order.

B. An isolated polypeptide encoding for a head of HUMIL10_P12 (SEQ ID NO:218), comprising a polypeptide being at least 70%, optionally at least about 80%, preferably at least about 85%, more preferably at least about 90% and most preferably at least about 95% homologous to the sequence MHSSALLCCLVLLTGVRA (SEQ ID NO: 586) of HUMIL10_P12 (SEQ ID NO:218).

C. An isolated chimeric polypeptide encoding for an edge portion of HUMIL10_P12 (SEQ ID NO:218), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CL, having a structure as follows: a sequence starting from any of amino acid numbers 126-x to 126; and ending at any of amino acid numbers 127+((n-2)-x), in which x varies from 0 to n-2.

6. Comparison report between HUMIL10_P12 (SEQ ID NO:218) and Q6LBF4_HUMAN (SEQ ID NO: 546):

A. An isolated chimeric polypeptide as set forth in HUMIL10_P12 (SEQ ID NO:218), comprising a first amino acid sequence being at least 90% homologous to MHSSALLCCLVLLTGVRASPGQGTQSENSCTHFPGNLPNMLRDLRDAFSRVKTFF corresponding to amino acids 1-55 of Q6LBF4_HUMAN (SEQ ID NO: 546), which also corresponds to amino acids 1-55 of HUMIL10_P12 (SEQ ID NO:218), and a second amino acid sequence being at least 70%, optionally at least 80%, preferably at least 85%, more preferably at least 90% and most preferably at least 95% homologous to a polypeptide having the sequence QMKDQLDNLLLKESLLEDFKGYLGCQALSEMIQFYLEEVMPQAENQDPDIKAHVNSLGENLKTLRLRLRRCLQ EKGIYKAMSEFDIFINYIEAYMTMKIRN (SEQ ID NO: 492) corresponding to amino acids 56-156 of HUMIL10_P12 (SEQ ID NO:218), wherein said first amino acid sequence and second amino acid sequence are contiguous and in a sequential order.

B. An isolated polypeptide as set forth in a tail of HUMIL10_P12 (SEQ ID NO:218), comprising a polypeptide being at least 70%, optionally at least about 80%, preferably at least about 85%, more preferably at least about 90% and most preferably at least about 95% homologous to the sequence QMKDQLDNLLLKESLLEDFKGYLGCQALSEMIQFYLEEVMPQAENQDPDIKAHVNSLGENLKTLRLRLRRCLQ EKGIYKAMSEFDIFINYIEAYMTMKIRN (SEQ ID NO: 492) of HUMIL10_P12 (SEQ ID NO:218)

The location of the variant protein was determined according to results from a number of different software programs and analyses, including analyses from SignalP and other specialized programs. The variant protein is secreted.

Variant protein HUMIL10_P12 (SEQ ID NO:218) also has the following non-silent SNPs (Single Nucleotide Polymorphisms) as listed in Table 215, (given according to their position(s) on the amino acid sequence, with the alternative amino acid(s) listed; the presence of known SNPs in variant protein HUMIL10_P12 (SEQ ID NO:218) sequence provides support for the deduced sequence of this variant protein according to the present invention).

TABLE 215

| Amino acid mutations | |
|---|---|
| SNP position(s) on amino acid sequence | Alternative amino acid(s) |
| 111 | S -> |

The glycosylation sites of variant protein HUMIL10_P12 (SEQ ID NO:218), as compared to the known protein Interleukin-10 precursor, are described in Table 216 (given according to their position(s) on the amino acid sequence in the first column; the second column indicates whether the glycosylation site is present in the variant protein; and the last column indicates whether the position is different on the variant protein).

TABLE 216

| Glycosylation site(s) | | |
|---|---|---|
| Position(s) on known amino acid sequence | Present in variant protein? | Position(s) on variant protein |
| 134 | No | |

Variant protein HUMIL10_P12 (SEQ ID NO:218) is encoded by the following transcript(s): HUMIL10_T8 (SEQ ID NO:213), for which the coding portion starts at position 60 and ends at position 527. The transcript also has the following SNPs as listed in Table 217 (given according to their position on the nucleotide sequence, with the alternative nucleic acid listed; the presence of known SNPs in variant protein HUMIL10_P12 (SEQ ID NO:218) sequence provides support for the deduced sequence of this variant protein according to the present invention).

TABLE 217

Nucleic acid SNPs

| Polymorphism | SNP position(s) on nucleotide sequence |
|---|---|
| C -> | 391 |
| C -> T | 404, 647, 1291 |
| T -> C | 566 |
| A -> G | 721, 982, 1482 |
| A -> | 850 |
| A -> T | 875 |
| G -> A | 1048, 1145 |

Variant protein HUMIL10_P13 (SEQ ID NO:219) according to the present invention has an amino acid sequence as given at the end of the application; it is encoded by transcript(s) HUMIL10_T10 (SEQ ID NO:214). An alignment is given to the known protein (Interleukin-10 precursor) in the alignment table on the attached CD-ROM. A brief description of the relationship of the variant protein according to the present invention to each such aligned protein is as follows:

1. Comparison report between HUMIL10_P13 (SEQ ID NO:219) and IL10_HUMAN (SEQ ID NO:423):

A. An isolated chimeric polypeptide as set forth in HUMIL10_P13 (SEQ ID NO:219), comprising a first amino acid sequence being at least 70%, optionally at least 80%, preferably at least 85%, more preferably at least 90% and most preferably at least 95%, homologous to a polypeptide having the sequence MPPACPLSVMDMELEARITNTFSFLPQ (SEQ ID NO: 587) corresponding to amino acids 1-27 of HUMIL10_P13 (SEQ ID NO:219), and a second amino acid sequence being at least 90% homologous to HRFLPCENK-SKAVEQVKNAFNKLQEKGIYKAMSEFDI-FINYIEAYMTMKIRN corresponding to amino acids 127-178 of IL10_HUMAN (SEQ ID NO:423), which also corresponds to amino acids 28-79 of HUMIL10_P13 (SEQ ID NO:219), wherein said first amino acid sequence and second amino acid sequence are contiguous and in a sequential order.

B. An isolated polypeptide encoding for a head of HUMIL10_P13 (SEQ ID NO:219), comprising a polypeptide being at least 70%, optionally at least about 80%, preferably at least about 85%, more preferably at least about 90% and most preferably at least about 95% homologous to the sequence MPPACPLSVMDMELEARITNTFSFLPQ (SEQ ID NO: 587) of HUMIL10_P13 (SEQ ID NO:219).

2. Comparison report between HUMIL10_P13 (SEQ ID NO:219) and Q71UZ1_HUMAN (SEQ ID NO: 542):

A. An isolated chimeric polypeptide as set forth in HUMIL10_P13 (SEQ ID NO:219), comprising a first amino acid sequence being at least 70%, optionally at least 80%, preferably at least 85%, more preferably at least 90% and most preferably at least 95%, homologous to a polypeptide having the sequence MPPACPLSVMDMELEARITNTFSFLPQ (SEQ ID NO: 587) corresponding to amino acids 1-27 of HUMIL10_P13 (SEQ ID NO:219), and a second amino acid sequence being at least 90% homologous to HRFLPCENK-SKAVEQVKNAFNKLQEKGIYKAMSEFDI-FINYIEAYMTMKIRN corresponding to amino acids 109-160 of Q71UZ1_HUMAN (SEQ ID NO: 542), which also corresponds to amino acids 28-79 of HUMIL10_P13 (SEQ ID NO:219), wherein said first amino acid sequence and second amino acid sequence are contiguous and in a sequential order.

B. An isolated polypeptide encoding for a head of HUMIL10_P13 (SEQ ID NO:219), comprising a polypeptide being at least 70%, optionally at least about 80%, preferably at least about 85%, more preferably at least about 90% and most preferably at least about 95% homologous to the sequence MPPACPLSVMDMELEARITNTFSFLPQ (SEQ ID NO: 587) of HUMIL10_P13 (SEQ ID NO:219).

5. Comparison report between HUMIL10_P13 (SEQ ID NO:219) and Q6FGS9_HUMAN (SEQ ID NO: 545):

A. An isolated chimeric polypeptide as set forth in HUMIL10_P13 (SEQ ID NO:219), comprising a first amino acid sequence being at least 70%, optionally at least 80%, preferably at least 85%, more preferably at least 90% and most preferably at least 95%, homologous to a polypeptide having the sequence MPPACPLSVMDMELEARITNTFSFLPQH (SEQ ID NO: 588) corresponding to amino acids 1-28 of HUMIL10_P13 (SEQ ID NO:219), and a second amino acid sequence being at least 90% homologous to RFLPCENK-SKAVEQVKNAFNKLQEKGIYKAMSEFDI-FINYIEAYMTMKIRN corresponding to amino acids 128-178 of Q6FGS9_HUMAN (SEQ ID NO: 545), which also corresponds to amino acids 29-79 of HUMIL10_P13 (SEQ ID NO:219), wherein said first amino acid sequence and second amino acid sequence are contiguous and in a sequential order.

B. An isolated polypeptide encoding for a head of HUMIL10_P13 (SEQ ID NO:219), comprising a polypeptide being at least 70%, optionally at least about 80%, preferably at least about 85%, more preferably at least about 90% and most preferably at least about 95% homologous to the sequence MPPACPLSVMDMELEARITNTFSFLPQH (SEQ ID NO: 588) of HUMIL10_P13 (SEQ ID NO:219).

The location of the variant protein was determined according to results from a number of different software programs and analyses, including analyses from SignalP and other specialized programs. The variant protein is intracellularl.

The glycosylation sites of variant protein HUMIL10_P13 (SEQ ID NO:219), as compared to the known protein Interleukin-10 precursor, are described in Table 218 (given according to their position(s) on the amino acid sequence in the first column; the second column indicates whether the glycosylation site is present in the variant protein; and the last column indicates whether the position is different on the variant protein).

TABLE 218

Glycosylation site(s)

| Position(s) on known amino acid sequence | Present in variant protein? | Position(s) on variant protein |
|---|---|---|
| 134 | Yes | 35 |

Variant protein HUMIL10_P13 (SEQ ID NO:219) is encoded by the following transcript(s): HUMIL10_T10 (SEQ ID NO:214), for which the coding portion starts at position 185 and ends at position 421. The transcript also has the following SNPs as listed in Table 219 (given according to their position on the nucleotide sequence, with the alternative nucleic acid listed; the presence of known SNPs in variant protein HUMIL10_P13 (SEQ ID NO:219) sequence provides support for the deduced sequence of this variant protein according to the present invention).

TABLE 219

Nucleic acid SNPs

| Polymorphism | SNP position(s) on nucleotide sequence |
|---|---|
| T -> G | 95 |
| G -> A | 140, 942, 1039 |
| A -> G | 154, 1376, 615, 876 |
| T -> C | 208, 460 |
| C -> T | 541, 1185 |
| A -> | 744 |
| A -> T | 769 |

As noted above, cluster HUMIL10 features 15 segment(s), which were listed in Table 203 above and for which the sequence(s) are given at the end of the application. These segment(s) are portions of nucleic acid sequence(s) which are described herein separately because they are of particular interest. A description of each segment according to the present invention is now provided.

Segment cluster HUMIL10_N0 (SEQ ID NO:220) according to the present invention is supported by 37 libraries. The number of libraries was determined as previously described. This segment can be found in the following transcript(s): HUMIL10_T5 (SEQ ID NO:211) and HUMIL10_T8 (SEQ ID NO:213). Table 220 below describes the starting and ending position of this segment on each transcript.

TABLE 220

Segment location on transcripts

| Transcript name | Segment starting position | Segment ending position |
|---|---|---|
| HUMIL10_T5 (SEQ ID NO: 211) | 1 | 209 |
| HUMIL10_T8 (SEQ ID NO: 213) | 1 | 209 |

Segment cluster HUMIL10_N5 (SEQ ID NO:223) according to the present invention is supported by 4 libraries. The number of libraries was determined as previously described. This segment can be found in the following transcript(s): HUMIL10_T6 (SEQ ID NO:212). Table 221 below describes the starting and ending position of this segment on each transcript.

TABLE 221

Segment location on transcripts

| Transcript name | Segment starting position | Segment ending position |
|---|---|---|
| HUMIL10_T6 (SEQ ID NO: 212) | 1 | 140 |

Segment cluster HUMIL10_N6 (SEQ ID NO:224) according to the present invention is supported by 53 libraries. The number of libraries was determined as previously described. This segment can be found in the following transcript(s): HUMIL10_T5 (SEQ ID NO:211), HUMIL10_T6 (SEQ ID NO:212) and HUMIL10_T8 (SEQ ID NO:213). Table 222 below describes the starting and ending position of this segment on each transcript.

TABLE 222

Segment location on transcripts

| Transcript name | Segment starting position | Segment ending position |
|---|---|---|
| HUMIL10_T5 (SEQ ID NO: 211) | 270 | 422 |
| HUMIL10_T6 (SEQ ID NO: 212) | 141 | 293 |
| HUMIL10_T8 (SEQ ID NO: 213) | 285 | 437 |

Segment cluster HUMIL10_N0 (SEQ ID NO:225) according to the present invention is supported by 1 libraries. The number of libraries was determined as previously described. This segment can be found in the following transcript(s): HUMIL10_10 (SEQ ID NO:214). Table 223 below describes the starting and ending position of this segment on each transcript.

TABLE 223

Segment location on transcripts

| Transcript name | Segment starting position | Segment ending position |
|---|---|---|
| HUMIL10_T10 (SEQ ID NO: 214) | 1 | 265 |

Segment cluster HUMIL10_N14 (SEQ ID NO:227) according to the present invention is supported by 57 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 224 below describes the starting and ending position of this segment on each transcript.

TABLE 224

Segment location on transcripts

| Transcript name | Segment starting position | Segment ending position |
|---|---|---|
| HUMIL10_T10 (SEQ ID NO: 214) | 332 | 789 |
| HUMIL10_T5 (SEQ ID NO: 211) | 489 | 946 |
| HUMIL10_T6 (SEQ ID NO: 212) | 360 | 817 |
| HUMIL10_T8 (SEQ ID NO: 213) | 438 | 895 |

Segment cluster HUMIL10_N16 (SEQ ID NO:229) according to the present invention is supported by 20 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 225 below describes the starting and ending position of this segment on each transcript.

TABLE 225

Segment location on transcripts

| Transcript name | Segment starting position | Segment ending position |
|---|---|---|
| HUMIL10_T10 (SEQ ID NO: 214) | 815 | 1027 |
| HUMIL10_T5 (SEQ ID NO: 211) | 972 | 1184 |
| HUMIL10_T6 (SEQ ID NO: 212) | 843 | 1055 |
| HUMIL10_T8 (SEQ ID NO: 213) | 921 | 1133 |

Segment cluster HUMIL10_N19 (SEQ ID NO:232) according to the present invention is supported by 18 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 226 below describes the starting and ending position of this segment on each transcript.

TABLE 226

Segment location on transcripts

| Transcript name | Segment starting position | Segment ending position |
|---|---|---|
| HUMIL10_T10 (SEQ ID NO: 214) | 1046 | 1259 |
| HUMIL10_T5 (SEQ ID NO: 211) | 1203 | 1416 |
| HUMIL10_T6 (SEQ ID NO: 212) | 1074 | 1287 |
| HUMIL10_T8 (SEQ ID NO: 213) | 1152 | 1365 |

According to an optional embodiment of the present invention, short segments related to the above cluster are also provided. These segments are up to about 120 bp in length, and so are included in a separate description.

Segment cluster HUMIL10_N1 (SEQ ID NO:221) according to the present invention is supported by 37 libraries. The number of libraries was determined as previously described. This segment can be found in the following transcript(s): HUMIL10_T8 (SEQ ID NO:213). Table 227 below describes the starting and ending position of this segment on each transcript.

TABLE 227

Segment location on transcripts

| Transcript name | Segment starting position | Segment ending position |
|---|---|---|
| HUMIL10_T8 (SEQ ID NO: 213) | 210 | 224 |

Segment cluster HUMIL10_N3 (SEQ ID NO:222) according to the present invention is supported by 38 libraries. The number of libraries was determined as previously described. This segment can be found in the following transcript(s): HUMIL10_T5 (SEQ ID NO:211) and HUMIL10_T8 (SEQ ID NO:213). Table 228 below describes the starting and ending position of this segment on each transcript.

TABLE 228

Segment location on transcripts

| Transcript name | Segment starting position | Segment ending position |
|---|---|---|
| HUMIL10_T5 (SEQ ID NO: 211) | 210 | 269 |
| HUMIL10_T8 (SEQ ID NO: 213) | 225 | 284 |

Segment cluster HUMIL10_N11 (SEQ ID NO:226) according to the present invention is supported by 50 libraries. The number of libraries was determined as previously described. This segment can be found in the following transcript(s): HUMIL10_T10 (SEQ ID NO:214), HUMIL10_T5 (SEQ ID NO:211) and HUMIL10_T6 (SEQ ID NO:212). Table 229 below describes the starting and ending position of this segment on each transcript.

TABLE 229

Segment location on transcripts

| Transcript name | Segment starting position | Segment ending position |
|---|---|---|
| HUMIL10_T10 (SEQ ID NO: 214) | 266 | 331 |
| HUMIL10_T5 (SEQ ID NO: 211) | 423 | 488 |
| HUMIL10_T6 (SEQ ID NO: 212) | 294 | 359 |

Segment cluster HUMIL10_N15 (SEQ ID NO:228) according to the present invention is supported by 18 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 230 below describes the starting and ending position of this segment on each transcript.

TABLE 230

Segment location on transcripts

| Transcript name | Segment starting position | Segment ending position |
|---|---|---|
| HUMIL10_T10 (SEQ ID NO: 214) | 790 | 814 |
| HUMIL10_T5 (SEQ ID NO: 211) | 947 | 971 |
| HUMIL10_T6 (SEQ ID NO: 212) | 818 | 842 |
| HUMIL10_T8 (SEQ ID NO: 213) | 896 | 920 |

Segment cluster HUMIL10_N17 (SEQ ID NO:230) according to the present invention is supported by 17 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 231 below describes the starting and ending position of this segment on each transcript.

TABLE 231

Segment location on transcripts

| Transcript name | Segment starting position | Segment ending position |
|---|---|---|
| HUMIL10_T10 (SEQ ID NO: 214) | 1028 | 1031 |
| HUMIL10_T5 (SEQ ID NO: 211) | 1185 | 1188 |
| HUMIL10_T6 (SEQ ID NO: 212) | 1056 | 1059 |
| HUMIL10_T8 (SEQ ID NO: 213) | 1134 | 1137 |

Segment cluster HUMIL10_N18 (SEQ ID NO:231) according to the present invention is supported by 17 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 232 below describes the starting and ending position of this segment on each transcript.

TABLE 232

Segment location on transcripts

| Transcript name | Segment starting position | Segment ending position |
|---|---|---|
| HUMIL10_T10 (SEQ ID NO: 214) | 1032 | 1045 |
| HUMIL10_T5 (SEQ ID NO: 211) | 1189 | 1202 |
| HUMIL10_T6 (SEQ ID NO: 212) | 1060 | 1073 |
| HUMIL10_T8 (SEQ ID NO: 213) | 1138 | 1151 |

Segment cluster HUMIL10_N20 (SEQ ID NO:233) according to the present invention is supported by 16 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 233 below describes the starting and ending position of this segment on each transcript.

TABLE 233

Segment location on transcripts

| Transcript name | Segment starting position | Segment ending position |
|---|---|---|
| HUMIL10_T10 (SEQ ID NO: 214) | 1260 | 1341 |
| HUMIL10_T5 (SEQ ID NO: 211) | 1417 | 1498 |
| HUMIL10_T6 (SEQ ID NO: 212) | 1288 | 1369 |
| HUMIL10_T8 (SEQ ID NO: 213) | 1366 | 1447 |

Segment cluster HUMIL10_N21 (SEQ ID NO:234) according to the present invention is supported by 14 libraries. The number of libraries was determined as previously described. This segment can be found in the following transcript(s): HUMIL10_T10 (SEQ ID NO:214), HUMIL10_T5 (SEQ ID NO:211), HUMIL10_T6 (SEQ ID NO:212) and HUMIL10_T8 (SEQ ID NO:213). Table 234 below describes the starting and ending position of this segment on each transcript.

TABLE 234

Segment location on transcripts

| Transcript name | Segment starting position | Segment ending position |
|---|---|---|
| HUMIL10_T10 (SEQ ID NO: 214) | 1342 | 1458 |
| HUMIL10_T5 (SEQ ID NO: 211) | 1499 | 1615 |
| HUMIL10_T6 (SEQ ID NO: 212) | 1370 | 1486 |
| HUMIL10_T8 (SEQ ID NO: 213) | 1448 | 1564 |

Figure 34:
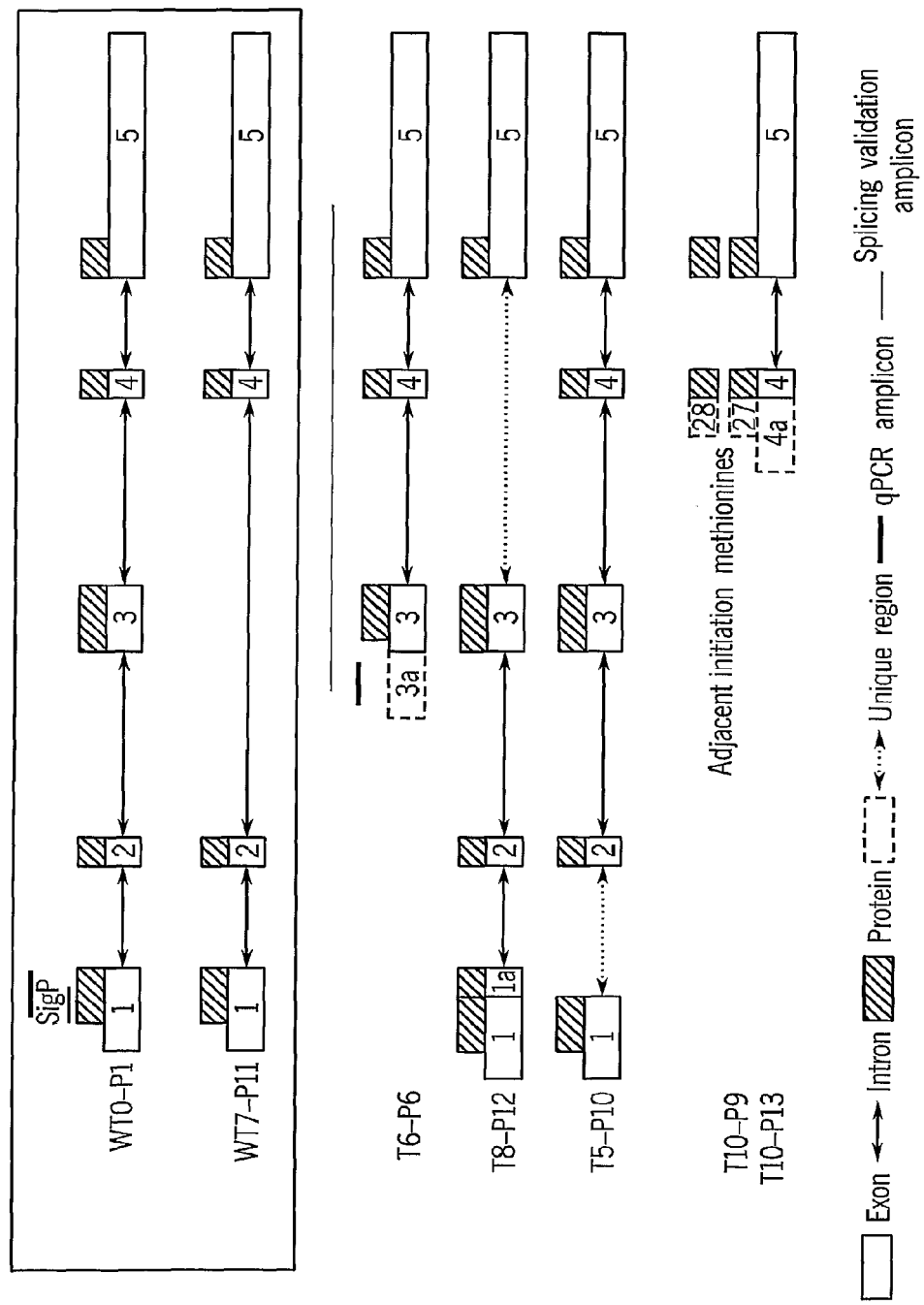
FIG. 34 shows the structure of the HUMIL10 mRNA and protein variants. Exons are represented by white boxes, while introns are represented by two headed arrows. Proteins are shown in boxes with upper right to lower left fill. The unique regions are represented by white boxes with dashed frame.

FIG. 34 shows the structure of the HUMIL10 mRNA and protein variants. Exons are represented by white boxes, while introns are represented by two headed arrows. Proteins are shown in boxes with upper right to lower left fill. The unique regions are represented by white boxes with dashed frame.

Figure 35A:
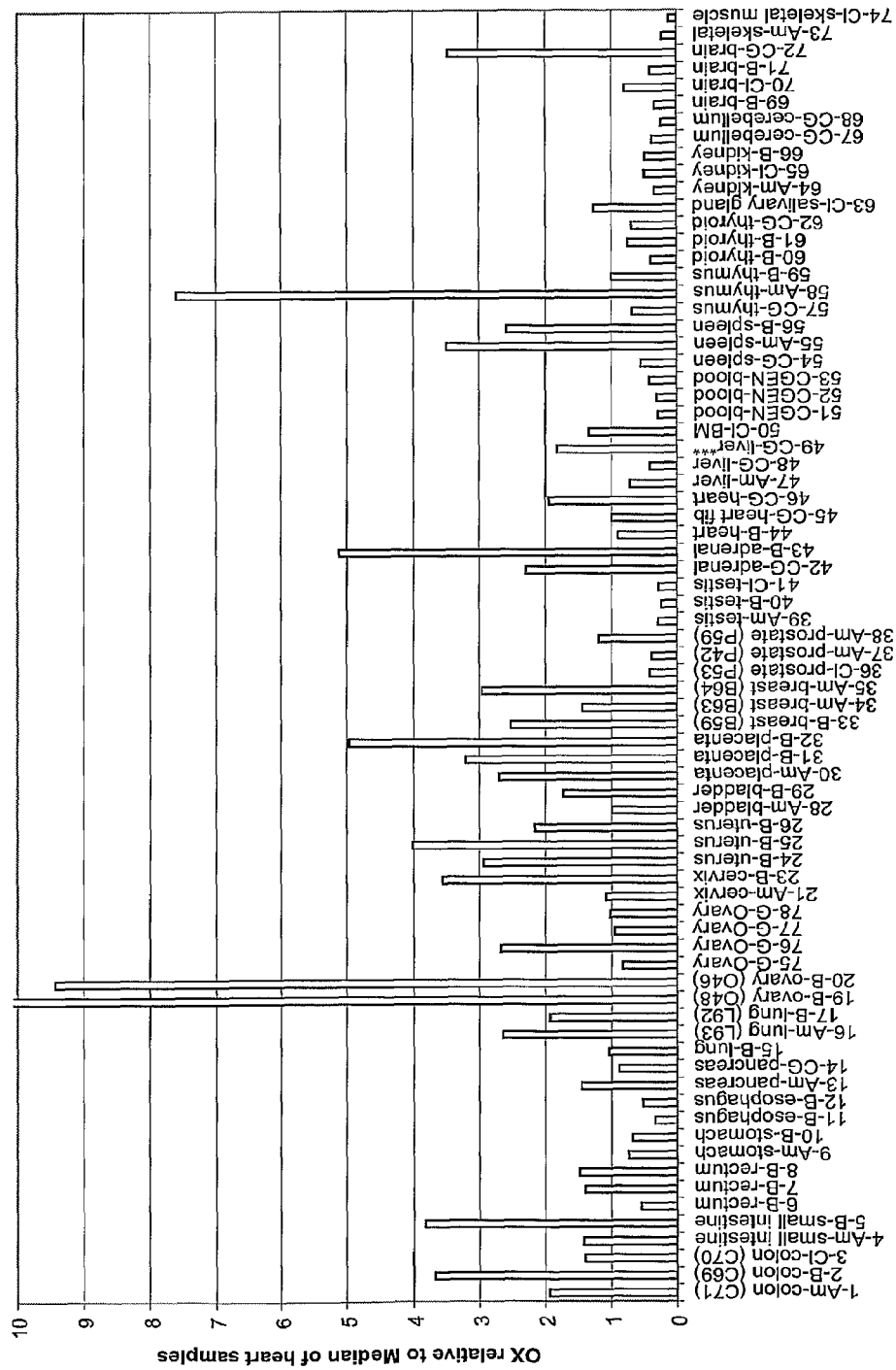
FIGS. 35A and 35B show expression of *Homo sapiens* interleukin 10 (IL10) transcripts detectable by or according to seg5, with the value of relative expression of each sample relative to median of the heart samples as shown in FIG. 35A, or with the value of relative expression of each sample relative to median of the blood samples as shown in FIG. 35B.
Figure 35B:
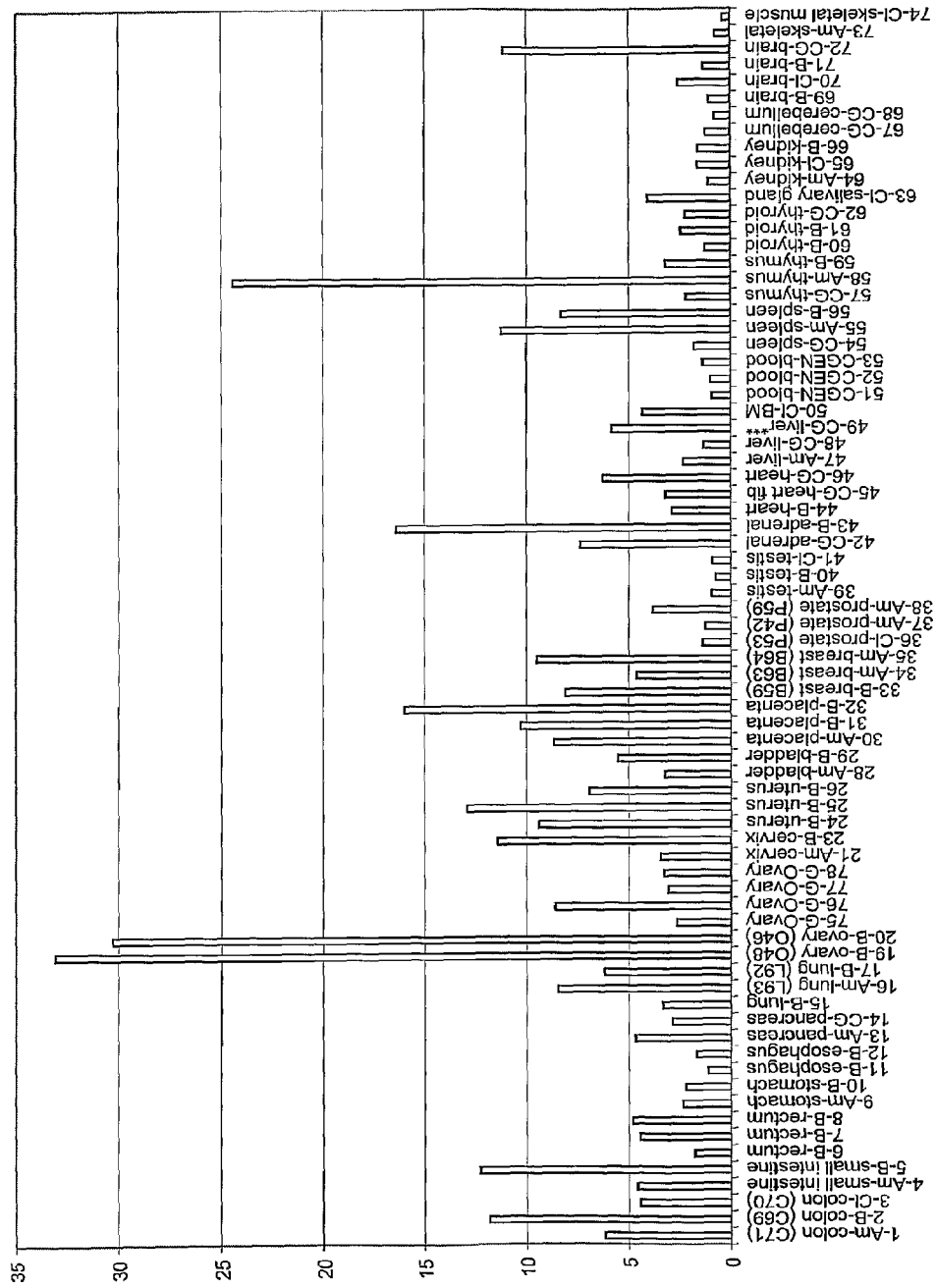

Expression of Homo sapiens Interleukin 10 (IL10) HUMIL10 Transcripts which are Detectable by Amplicon as Depicted in Sequence Name HUMIL10_seg5 (SEQ ID NO:424) in Different Normal Tissues Expression of Homo sapiens interleukin 10 (IL10) transcripts detectable by or according to seg5-HUMIL10_seg5 (SEQ ID NO:424) amplicon and primers HUMIL10_seg5F (SEQ ID NO:425) and HUMIL10_seg5R (SEQ ID NO:426) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the heart samples (sample numbers 44, 45 and 46, Table 5 above), to obtain a value of relative expression of each sample relative to median of the heart samples as shown in FIG. 35A, or by the median of the blood samples (sample numbers 51-53), to obtain a value of relative expression of each sample relative to median of the blood samples as shown in FIG. 35B.

```
Forward Primer (HUMIL10_seg5F (SEQ ID NO: 425)):
TCTGGTGAAGGAGGATCGCT

Reverse Primer (HUMIL10_seg5R (SEQ ID NO: 426)):
GAGTGAGAGATTGGCGGAGGT

Amplicon (HUMIL10_seg5 (SEQ ID NO: 424)):
TCTGGTGAAGGAGGATCGCTAGAACCAAGCTGTCCTCTTAAG
CTAGTTGCAGCAGCCCCTCCTCCCAGCCACCTCCGCCA
ATCTCTCACTC
```

Figure 36A:
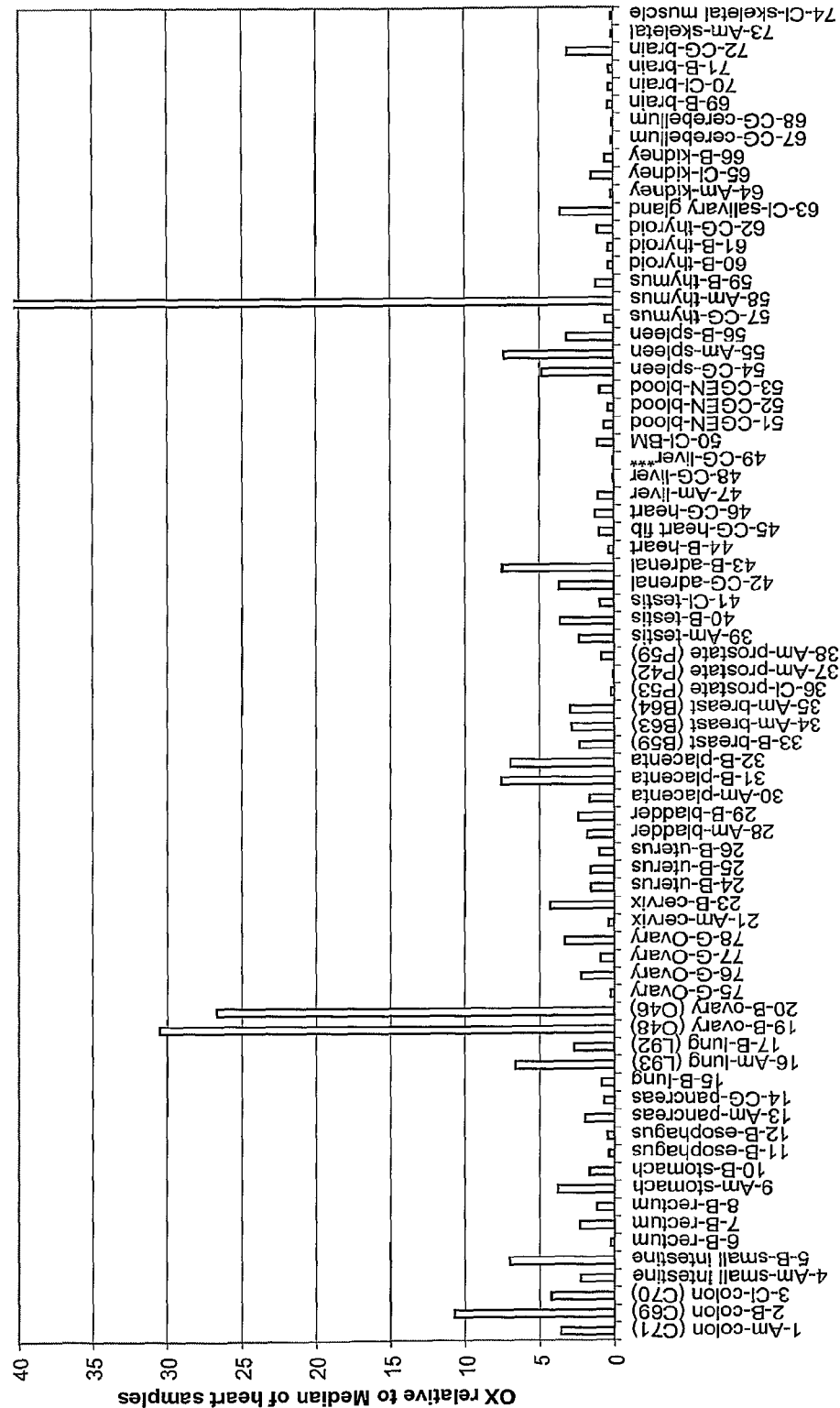
FIGS. 36A and 36B show expression of *Homo sapiens* interleukin 10 (IL10) transcripts detectable by or according to seg0WT, with the value of relative expression of each sample relative to median of the heart samples as shown in FIG. 36A, or with the value of relative expression of each sample relative to median of the blood samples as shown in FIG. 36B.
Figure 36B:
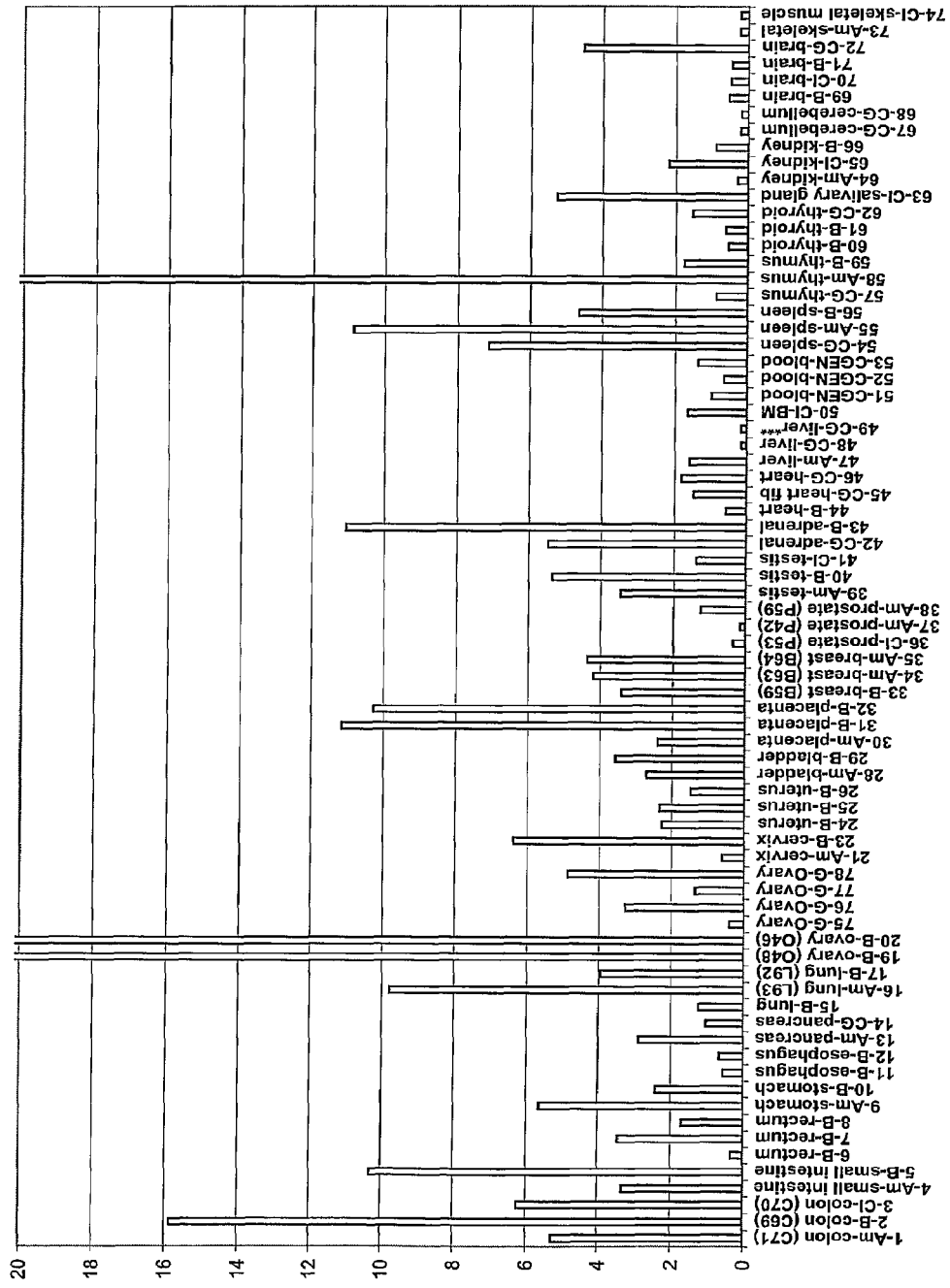

Expression of *Homo sapiens* Interleukin 10 (IL10) HUMIL10 Transcripts which are Detectable by Amplicon as Depicted in Sequence Name HUMIL10_seg0WT (SEQ ID NO:427) in Different Normal Tissues Expression of *Homo sapiens* interleukin 10 (IL10) transcripts detectable by or according to seg0WT—HUMIL10_seg0WT (SEQ ID NO:427) amplicon and primers HUMIL10_seg0WTF (SEQ ID NO:428) and HUMIL10_seg0WTR (SEQ ID NO:429) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the heart samples (sample numbers 44, 45 and 46, Table 5 above), to obtain a value of relative expression of each sample relative to median of the heart samples as shown in FIG. 36A, or by the median of the blood samples (sample numbers 51-53), to obtain a value of relative expression of each sample relative to median of the blood samples as shown in FIG. 36B.

```
Forward Primer (HUMIL10_seg0WTF (SEQ ID NO: 428)):
AAGAAGGCATGCACAGCTCAG

Reverse Primer (HUMIL10_seg0WTR (SEQ ID NO: 429)):
TCTCGAAGCATGTTAGGCAGG

Amplicon (HUMIL10_seg0WT (SEQ ID NO: 427)):
AAGAAGGCATGCACAGCTCAGCACTGCTCTGTTGCCTGGTCCT
CCTGACTGGGGTGAGGGCCAGCCCAGGCCAGGGCACCCAGTC
TGAGAACAGCTGCACCCACTTCCCAGGCAACCTGCCTAACATG
CTTCGAGA
```

Description for Cluster AA336074

Cluster AA336074 features 1 transcript(s) and 7 segment(s) of interest, the names for which are given in Tables 235 and 236, respectively. The selected protein variants are given in table 237.

TABLE 235

| Transcripts of interest Transcript Name |
|---|
| AA336074_T20 (SEQ ID NO: 235) |

TABLE 236

| Segments of interest Segment Name |
|---|
| AA336074_N4 (SEQ ID NO: 239) |
| AA336074_N9 (SEQ ID NO: 240) |
| AA336074_N28 (SEQ ID NO: 241) |
| AA336074_N31 (SEQ ID NO: 242) |
| AA336074_N32 (SEQ ID NO: 243) |

TABLE 236-continued

| Segments of interest Segment Name |
|---|
| AA336074_N0 (SEQ ID NO: 237) |
| AA336074_N2 (SEQ ID NO: 238) |

TABLE 237

| Proteins of interest | |
|---|---|
| Protein Name | Corresponding Transcript(s) |
| AA336074_P30 (SEQ ID NO: 236) | AA336074_T20 (SEQ ID NO: 235) |

These sequences are variants of the known protein Kallikrein 4 precursor (SwissProt accession identifier KLK4_HUMAN (SEQ ID NO:430) (SEQ ID NO: 1029); known also according to the synonyms EC 3.4.21; Prostase; Kallikrein-like protein 1; KLK-L1; Enamel matrix serine proteinase 1), referred to herein as the previously known protein. Known polymorphisms for this sequence are as shown in Table 238

TABLE 238

| Amino acid mutations for Known Protein | |
|---|---|
| SNP position(s) on amino acid sequence | Comment |
| 197 | Q -> H |

Protein Kallikrein 4 precursor localization is believed to be Secreted.

The following GO Annotation(s) apply to the previously known protein. The following annotation(s) were found: proteolysis and peptidolysis, which are annotation(s) related to Biological Process; serine-type peptidase activity, which are annotation(s) related to Molecular Function; and extracellular region, which are annotation(s) related to Cellular Component.

The GO assignment relies on information from one or more of the SwissProt/TremBl Protein knowledgebase or Locuslink.

According to optional embodiments of the present invention, variants of this cluster according to the present invention (amino acid and/or nucleic acid sequences of AA336074) may optionally have one or more of the following utilities, as described in greater detail below. It should be noted that these utilities are optionally and preferably suitable for human and non-human animals as subjects, except where otherwise noted. The reasoning is described with regard to biological and/or physiological and/or other information about the known protein, but is given to demonstrate particular diagnostic utility for the variants according to the present invention.

A non-limiting example of such a utility is the detection, diagnosis and/or determination of diagnosis of prostate cancer. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Involvement of the known Kallikrein 4 for the above utility is described with regard to EP Patent No. EP1294941B1, hereby incorporated by reference as if fully set forth herein.

Another non-limiting example of such a utility is detecting or monitoring prostate or ovarian cancer in combination with human kallikrein 11. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utilities is described with regard to US Patent Application No. US20040203012, hereby incorporated by reference as if fully set forth herein.

Another non-limiting example of such a utility is detecting ovarian cancer in combination with KLK9. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utilities is described with regard to US Patent Application No. US20050176002, hereby incorporated by reference as if fully set forth herein.

Another non-limiting example of such a utility is diagnosing and monitoring renal cell carcinoma. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utility is described with regard to PCT Application No. WO 04/077060, hereby incorporated by reference as if fully set forth herein.

Another non-limiting example of such a utility is detecting endocrine cancer in combination with kallikrein 13. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utility is described with regard to PCT Application No. WO 04/021009, hereby incorporated by reference as if fully set forth herein.

Another non-limiting example of such a utility is detecting breast or ovarian cancer in combination with kallikrein 5. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utility is described with regard to PCT Application No. WO 04/021008, hereby incorporated by reference as if fully set forth herein.

Another non-limiting example of such a utility is detecting ovarian cancer in combination with kallikrein 8. The method comprises detecting a AA336074 variant, for example a variant protein, protein fragment, peptide, polynucleotide, polynucleotide fragment and/or oligonucleotide as described herein, optionally and preferably in a serum sample. The expression levels of the AA336074 variant as determined in a patient can be further compared to those in a normal individual.

Differential expression of the known Kallikrein 4 for the above utility is described with regard to PCT Application No. WO 03/085404, hereby incorporated by reference as if fully set forth herein.

According to optional embodiments of the present invention, variants of this cluster according to the present invention (amino acid and/or nucleic acid sequences of AA336074) may optionally have one or more of the following utilities, as described with regard to the Table below. It should be noted that these utilities are optionally and preferably suitable for human and non-human animals as subjects, except where otherwise noted. The reasoning is described with regard to biological and/or physiological and/or other information about the known protein, but is given to demonstrate particular diagnostic utility for the variants according to the present invention.

TABLE 239

Table of Utilities for Variants of AA336074, related to Kallikrein 4:

| Utility | Reason | Reference |
|---|---|---|
| Over expression in prostate cancer (detection in serum and ICH). | | Ovesen J., et al., Acta Otolaryngol Suppl. 1992;492:113-4 |
| highly expressed for diagnosis of serous ovarian carcinomas | | Veveris-Lowe TL.., et al., Endocr Relat Cancer. 2005 12(3):631-43. |
| Higher expression indicates poor prognosis of ovarian cancer patients | | Dong Y et al., Clin Cancer Res. 2001 Aug;7(8):2363-71; Obiezu CV., et al., Clin Cancer Res. 2001 Aug;7(8):2380-6 |
| theranostics marker for paclitaxel resistance in ovarian cancer | overexpression is an exclusion criteria for the treatment. | Xi Z., et al., 2004 94(1):80-5. |

TABLE 239-continued

Table of Utilities for Variants of AA336074, related to Kallikrein 4:

| Utility | Reason | Reference |
|---|---|---|
| alteration in sequence and expression as markers for amelogenesis imperfecta | | Stephanopoulos G., et al., J Dent Res. 2005 84(12):1117-26; Ozdemir D. et al., J Dent Res. 2005 84(11):1031-5; Nagano T., et al., J Dent Res. 200382(12):982-6. |

Other non-limiting exemplary utilities for AA336074 variants according to the present invention are described in greater detail below and also with regard to the previous section on clinical utility.

Cluster AA336074 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 37 refer to weighted expression of ESTs in each category, as "parts per million" (ratio of the expression of ESTs for a particular cluster to the expression of all ESTs in that category, according to parts per million).

Figure 37:
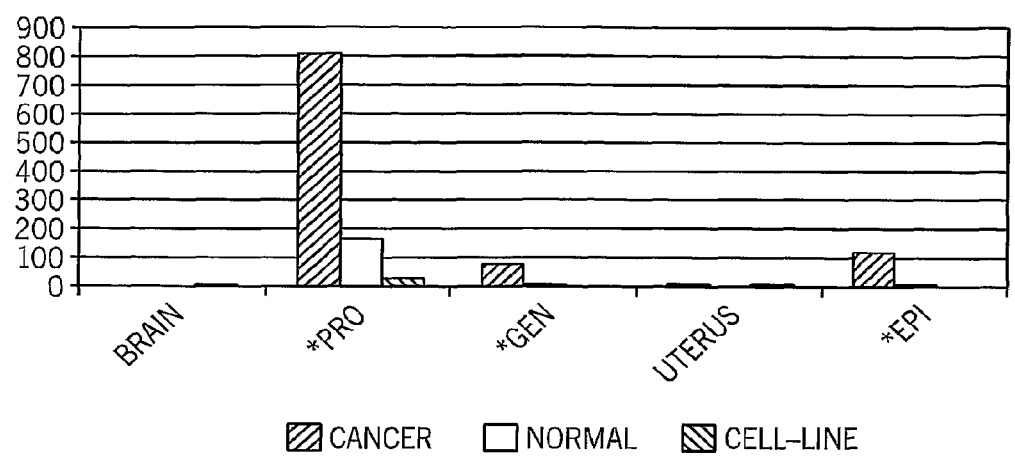
FIG. 37 shows that cluster AA336074 is overexpressed (at least at a minimum level) in the following pathological conditions: prostate cancer, a mixture of malignant tumors from different tissues and epithelial malignant tumors.

Overall, the following results were obtained as shown with regard to the histograms in FIG. 34 and Table 240. As shown in FIG. 37 cluster AA336074 is overexpressed (at least at a minimum level) in the following pathological conditions: prostate cancer, a mixture of malignant tumors from different tissues and epithelial malignant tumors.

TABLE 240

Normal tissue distribution

| Name of Tissue | Number |
|---|---|
| brain | 0 |
| prostate | 167 |
| general | 5 |
| uterus | 0 |
| epithelial | 13 |

TABLE 241

P values and ratios for expression in cancerous tissue

| Name of Tissue | P1 | P2 | SP1 | R3 | SP2 | R4 |
|---|---|---|---|---|---|---|
| brain | N/A | 3.1e-01 | N/A | N/A | 3.7e-01 | 2.7 |
| prostate | 4.4e-01 | 5.7e-01 | 7.0e-08 | 3.4 | 6.5e-05 | 2.4 |
| general | 5.9e-04 | 5.0e-03 | 6.2e-29 | 11.0 | 6.1e-16 | 5.7 |
| uterus | 4.4e-01 | 3.7e-01 | 6.6e-01 | 1.5 | 6.4e-01 | 1.5 |
| epithelial | 1.0e-02 | 5.8e-02 | 2.5e-15 | 6.2 | 3.7e-07 | 3.2 |

As noted above, cluster AA336074 features 1 transcript(s), which were listed in Table 235 above. These transcript(s) encode for protein(s) which are variant(s) of protein Kallikrein 4 precursor. A description of each variant protein according to the present invention is now provided.

Variant protein AA336074_P30 (SEQ ID NO:236) according to the present invention has an amino acid sequence as given at the end of the application; it is encoded by transcript(s) AA336074_T20 (SEQ ID NO:235). An alignment is given to the known protein (Kallikrein 4 precursor) in the alignment table on the attached CD-ROM. A brief description of the relationship of the variant protein according to the present invention to each such aligned protein is as follows:

1. Comparison report between AA336074_P30 (SEQ ID NO:236) and KLK4_HUMAN (SEQ ID NO:430) (SEQ ID NO: 1029):

A. An isolated chimeric polypeptide as set forth in AA336074_P30 (SEQ ID NO:236), comprising a first amino acid sequence being at least 90% homologous to MATAGNPWGWFLGYLILGVAGSLVSGSCSQI-INGEDCSPHSQPWQAALVMENELFCSGV-LVHPQWVLSAAHC FQNSYTIGLGLHSLEADQEPGSQMVEA-SLSVRHPEYNRPLLANDLMLIKLDESVS-ESDTIRSISIASQCPTAGNSC LVSGWGLLAN corresponding to amino acids 1-158 of KLK4_HUMAN (SEQ ID NO:430) (SEQ ID NO: 1029), which also corresponds to amino acids 1-158 of AA336074_P30 (SEQ ID NO:236), and a second amino acid sequence being at least 70%, optionally at least 80%, preferably at least 85%, more preferably at least 90% and most preferably at least 95% homologous to a polypeptide having the sequence DAVIAIQSQTVGG-WECEKLSQPWQGCTISATSSARTSC-CILTGCSLLLTASPGVEIRRDSAGCSHMIKEGPELGV TPDPS (SEQ ID NO: 493) corresponding to amino acids 159-238 of AA336074_P30 (SEQ ID NO:236), wherein said first amino acid sequence and second amino acid sequence are contiguous and in a sequential order.

B. An isolated polypeptide encoding for an edge portion of AA336074_P30 (SEQ ID NO:236), comprising an amino acid sequence being at least 70%, optionally at least about 80%, preferably at least about 85%, more preferably at least about 90% and most preferably at least about 95% homologous to the sequence DAVIAIQSQTVGGWECEKLSQP-WQGCTISATSSARTSCCILTGCSLLL-TASPGVEIRRDSAGCSHMIKEGPELGV TPDPS (SEQ ID NO: 493) of AA336074_P30 (SEQ ID NO:236).

The localization of the variant protein was determined according to results from a number of different software programs and analyses, including analyses from SignalP and other specialized programs. The variant protein is secreted.

Variant protein AA336074_P30 (SEQ ID NO:236) also has the following non-silent SNPs (Single Nucleotide Polymorphisms) as listed in Table 242, (given according to their position(s) on the amino acid sequence, with the alternative amino acid(s) listed; the presence of known SNPs in variant protein AA336074_P30 (SEQ ID NO:236) sequence provides support for the deduced sequence of this variant protein according to the present invention).

TABLE 242

Amino acid mutations

| SNP position(s) on amino acid sequence | Alternative amino acid(s) |
|---|---|
| 22 | S -> A |
| 43 | P -> T |

The glycosylation sites of variant protein AA336074_P30 (SEQ ID NO:236), as compared to the known protein Kallikrein 4 precursor, are described in Table 243 (given according to their position(s) on the amino acid sequence in the first column; the second column indicates whether the glycosylation site is present in the variant protein; and the last column indicates whether the position is different on the variant protein).

TABLE 243

| Glycosylation site(s) | | |
|---|---|---|
| Position(s) on known amino acid sequence | Present in variant protein? | Position(s) on variant protein |
| 169 | No | |

Variant protein AA336074_P30 (SEQ ID NO:236) is encoded by the following transcript(s): AA336074_T20 (SEQ ID NO:235), for which the coding portion starts at position 61 and ends at position 774. The transcript also has the following SNPs as listed in Table 244 (given according to their position on the nucleotide sequence, with the alternative nucleic acid listed; the presence of known SNPs in variant protein AA336074_P30 (SEQ ID NO:236) sequence provides support for the deduced sequence of this variant protein according to the present invention).

TABLE 244

| Nucleic acid SNPs | |
|---|---|
| Polymorphism | SNP position(s) on nucleotide sequence |
| T -> G | 124, 126 |
| C -> A | 187, 1651 |
| C -> T | 360 |
| G -> A | 525 |
| C -> G | 1716 |
| T -> C | 1797 |

As noted above, cluster AA336074 features 7 segment(s), which were listed in Table 236 above and for which the sequence(s) are given at the end of the application. These segment(s) are portions of nucleic acid sequence(s) which are described herein separately because they are of particular interest. A description of each segment according to the present invention is now provided.

Segment cluster AA336074_N4 (SEQ ID NO:239) according to the present invention is supported by 54 libraries. The number of libraries was determined as previously described. This segment can be found in the following transcript(s): AA336074_T20 (SEQ ID NO:235). Table 245 below describes the starting and ending position of this segment on each transcript.

TABLE 245

| Segment location on transcripts | | |
|---|---|---|
| Transcript name | Segment starting position | Segment ending position |
| AA336074_T20 (SEQ ID NO: 235) | 122 | 284 |

Segment cluster AA336074_N9 (SEQ ID NO:240) according to the present invention is supported by 77 libraries. The number of libraries was determined as previously described. This segment can be found in the following transcript(s): AA336074_T20 (SEQ ID NO:235). Table 246 below describes the starting and ending position of this segment on each transcript.

TABLE 246

| Segment location on transcripts | | |
|---|---|---|
| Transcript name | Segment starting position | Segment ending position |
| AA336074_T20 (SEQ ID NO: 235) | 285 | 535 |

Segment cluster AA336074_N28 (SEQ ID NO:241) according to the present invention is supported by 5 libraries. The number of libraries was determined as previously described. This segment can be found in the following transcript(s): AA336074_T20 (SEQ ID NO:235). Table 247 below describes the starting and ending position of this segment on each transcript.

TABLE 247

| Segment location on transcripts | | |
|---|---|---|
| Transcript name | Segment starting position | Segment ending position |
| AA336074_T20 (SEQ ID NO: 235) | 536 | 691 |

Segment cluster AA336074_N31 (SEQ ID NO:242) according to the present invention is supported by 3 libraries. The number of libraries was determined as previously described. This segment can be found in the following transcript(s): AA336074_T20 (SEQ ID NO:235). Table 248 below describes the starting and ending position of this segment on each transcript.

TABLE 248

| Segment location on transcripts | | |
|---|---|---|
| Transcript name | Segment starting position | Segment ending position |
| AA336074_T20 (SEQ ID NO: 235) | 692 | 1258 |

Segment cluster AA336074_N32 (SEQ ID NO:243) according to the present invention is supported by 8 libraries. The number of libraries was determined as previously described. This segment can be found in the following transcript(s): AA336074_T20 (SEQ ID NO:235). Table 249 below describes the starting and ending position of this segment on each transcript.

TABLE 249

| Segment location on transcripts | | |
|---|---|---|
| Transcript name | Segment starting position | Segment ending position |
| AA336074_T20 (SEQ ID NO: 235) | 1259 | 1849 |

According to an optional embodiment of the present invention, short segments related to the above cluster are also provided. These segments are up to about 120 bp in length, and so are included in a separate description.

Segment cluster AA336074_N0 (SEQ ID NO:237) according to the present invention is supported by 1 libraries. The number of libraries was determined as previously described. This segment can be found in the following transcript(s): AA336074_T20 (SEQ ID NO:235). Table 250 below describes the starting and ending position of this segment on each transcript.

TABLE 250

Segment location on transcripts

| Transcript name | Segment starting position | Segment ending position |
|---|---|---|
| AA336074_T20 (SEQ ID NO: 235) | 1 | 49 |

Segment cluster AA336074_N2 (SEQ ID NO:238) according to the present invention is supported by 11 libraries. The number of libraries was determined as previously described. This segment can be found in the following transcript(s): AA336074_T20 (SEQ ID NO:235). Table 251 below describes the starting and ending position of this segment on each transcript.

TABLE 251

Segment location on transcripts

| Transcript name | Segment starting position | Segment ending position |
|---|---|---|
| AA336074_T20 (SEQ ID NO: 235) | 50 | 121 |

Figure 38:
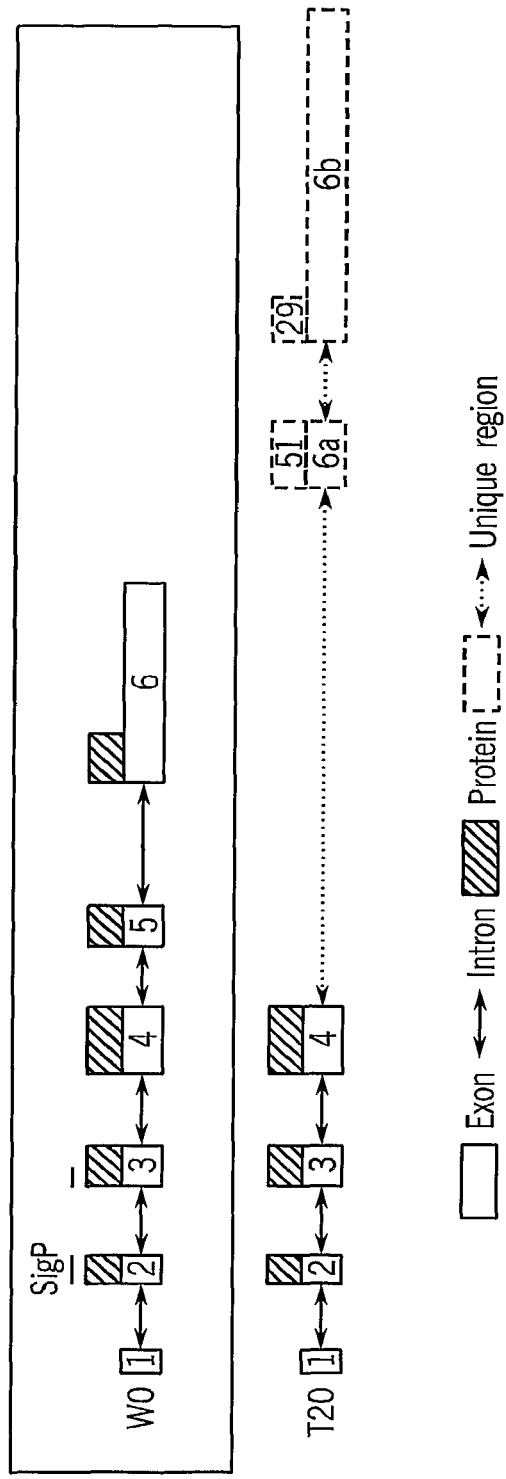
FIG. 38 shows the structure of the AA336074 mRNA and protein variants. Exons are represented by white boxes, while introns are represented by two headed arrows. Proteins are shown in boxes with upper right to lower left fill. The unique regions are represented by white boxes with dashed frame.

FIG. 38 shows the structure of the AA336074 mRNA and protein variants. Exons are represented by white boxes, while introns are represented by two headed arrows. Proteins are shown in boxes with upper right to lower left fill. The unique regions are represented by white boxes with dashed frame. Expression of *Homo sapiens* Kallikrein 4 (Prostase, Enamel Matrix, Prostate) (KLK4) AA336074 Transcripts which are Detectable by Amplicon as Depicted in Sequence Name AA336074_junc9-28 (SEQ ID NO:431) in Normal and Cancerous Breast Tissues Expression of *Homo sapiens* kallikrein 4 (prostase, enamel matrix, prostate) (KLK4) transcripts detectable by or according to junc9-28—AA336074_junc9-28 (SEQ ID NO:431) amplicon and primers AA336074_junc9-28F (SEQ ID NO:432) and AA336074_junc9-28R (SEQ ID NO:433) was measured by real time PCR. In parallel the expression of four housekeeping genes—G6PD (GenBank Accession No. NM_000402 (SEQ ID NO:405); G6PD (SEQ ID NO:404) amplicon), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the geometric mean of the quantities of the housekeeping genes. The normalized quantity of each RT sample was then divided by the median of the quantities of the normal post-mortem or post surgery (PM/PS) samples (sample numbers 57, 59, 60, 63, 66, 64, 56, 65 and 67, Table 4 above), to obtain a value of fold up-regulation for each sample relative to median of the normal PM samples.

Figure 39:
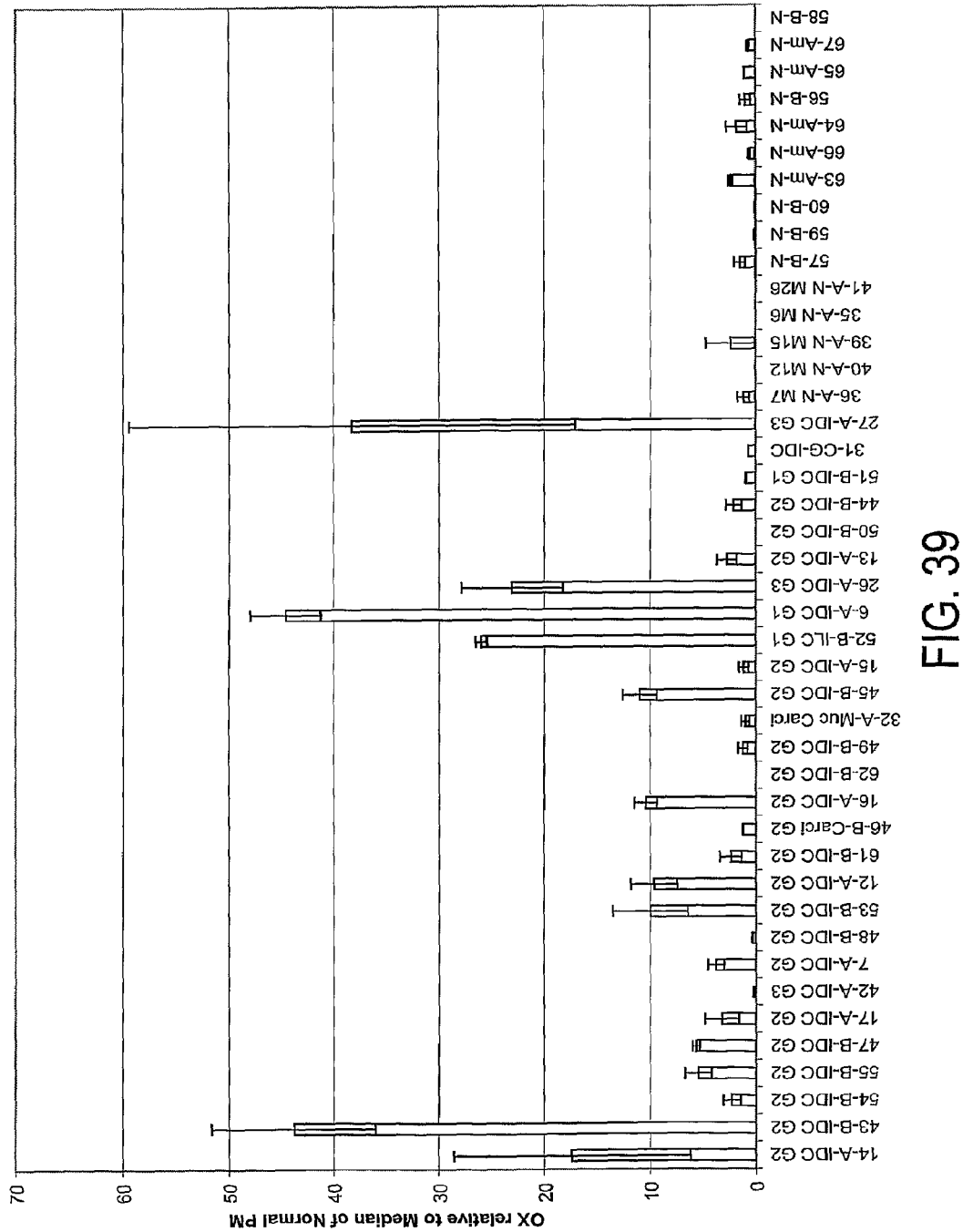
FIG. 39 is a histogram showing Expression of *Homo sapiens* kallikrein 4 ((KLK4) AA336074 transcripts which are detectable by amplicon as depicted in sequence name AA336074_junc9-28 (SEQ ID NO:431) in normal and cancerous Breast tissues.

FIG. 39 is a histogram showing over expression of the above-indicated *Homo sapiens* kallikrein 4 (prostase, enamel matrix, prostate) (KLK4) transcripts in cancerous Breast samples relative to the normal samples. Values represent the average of duplicate experiments. Error bars indicate the minimal and maximal values obtained.

As is evident from FIG. 39, the expression of *Homo sapiens* kallikrein 4 (prostase, enamel matrix, prostate) (KLK4) transcripts detectable by the above amplicon in cancer samples was significantly higher than in the non-cancerous samples (sample numbers 57, 59, 60, 63, 66, 64, 56, 65 and 67, Table 4 above). Notably an over-expression of at least 5 fold was found in 12 out of 26 adenocarcinoma samples.

Statistical analysis was applied to verify the significance of these results, as described below.

The P value for the difference in the expression levels of *Homo sapiens* kallikrein 4 (prostase, enamel matrix, prostate) (KLK4) transcripts detectable by the above amplicon in Breast cancer samples versus the normal tissue samples was determined by T test as 1.88e-03.

Threshold of 5 fold over expression was found to differentiate between cancer and normal samples with P value of 1.16e-02 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: AA336074_junc9-28F (SEQ ID NO:432) forward primer; and AA336074_junc9-28R (SEQ ID NO:433) reverse primer.

The present invention also preferably encompasses any amplicon obtained through the use of any suitable primer pair; for example, for the above experiment, the following amplicon was obtained as a non-limiting illustrative example only of a suitable amplicon: AA336074_junc9-28 (SEQ ID NO:431).

Forward Primer (AA336074_junc9-28F (SEQ ID NO: 432)):
CTGCTGGCGAACGATGCT

Reverse Primer (AA336074_junc9-28R (SEQ ID NO: 433)):
GCCGAAATGGTACAACCCTG

Amplicon (AA336074_junc9-28 (SEQ ID NO: 431)):
CTGCTGGCGAACGATGCTGTGATTGCCATCCAGTCCCAGACTGTGGGA
GGCTGGGAGTGTGAGAAGCTTTCCCAACCCTGGCAGGGTTGTACCAT
TTCGGC Expression of *Homo sapiens* Kallikrein 4 (Prostase, Enamel Matrix, Prostate) (KLK4) AA336074 Transcripts which are Detectable by Amplicon as Depicted in Sequence Name AA336074_junc9-28 (SEQ ID NO:431) in Different Normal Tissues Expression of *Homo sapiens* kallikrein 4 (prostase, enamel matrix, prostate) (KLK4) transcripts detectable by or according to junc9-28—AA336074_junc9-28 (SEQ ID NO:431) amplicon and primers AA336074_junc9-28F (SEQ ID NO:432) and AA336074_junc9-28R (SEQ ID NO:433) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the breast samples (sample numbers 34 and 35, Table 5 above), to obtain a value of relative expression of each sample relative to median of the breast samples.

Figure 40:
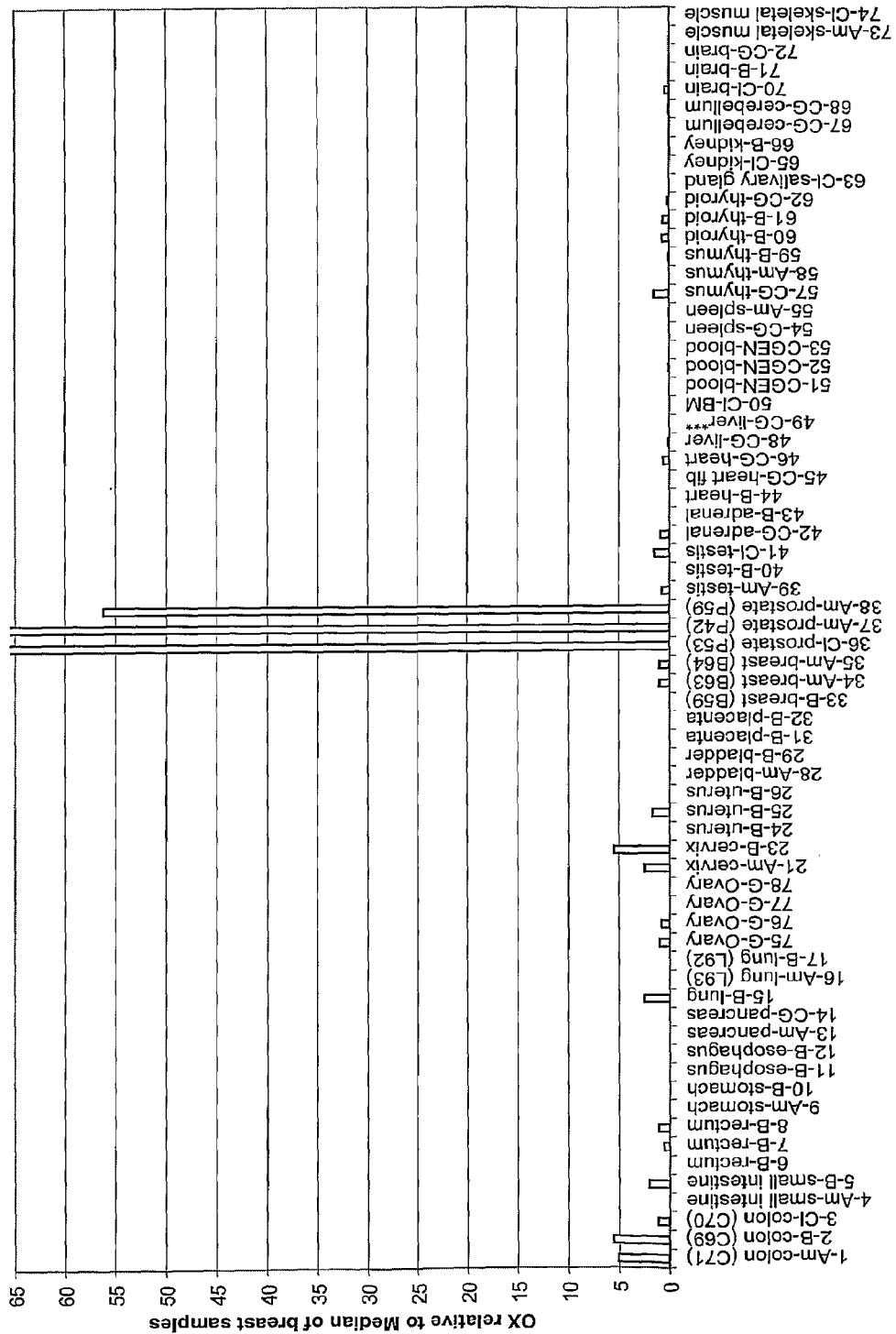
FIG. 40 is a histogram showing the expression of *Homo sapiens* kallikrein 4 (KLK4) AA336074 transcripts which are detectable by amplicon as depicted in sequence name AA336074_junc9-28 (SEQ ID NO:431) in different normal tissues.

FIG. 40 is a histogram showing the expression of *Homo sapiens* kallikrein 4 (prostase, enamel matrix, prostate) (KLK4) AA336074 transcripts which are detectable by amplicon as depicted in sequence name AA336074_junc9-28 (SEQ ID NO:431) in different normal tissues.

```
Forward Primer (AA336074_junc9-28F (SEQ ID
NO: 432)):
CTGCTGGCGAACGATGCT

Reverse Primer (AA336074_junc9-28R (SEQ ID
NO: 433)):
GCCGAAATGGTACAACCCTG

Amplicon (AA336074_junc9-28 (SEQ ID NO: 431)):
CTGCTGGCGAACGATGCTGTGATTGCCATCCAGTCCCAGACTGTGGG
AGGCTGGGAGTGTGAGAAGCTTTCCCAACCCTGGCAGGGTTGTACCAT
TTCGGC
```

Expression of *Homo sapiens* Kallikrein 4 (Prostase, Enamel Matrix, Prostate) (KLK4) AA336074 Transcripts which are Detectable by Amplicon as Depicted in Sequence Name AA336074_seg13WT (SEQ ID NO:434) in Normal and Cancerous Breast Tissues Expression of *Homo sapiens* kallikrein 4 (prostase, enamel matrix, prostate) (KLK4) transcripts detectable by or according to seg13WT—AA336074_seg13WT (SEQ ID NO:434) amplicon and primers AA336074_seg13WTF (SEQ ID NO:435) and AA336074_seg13WTR (SEQ ID NO:436) was measured by real time PCR. In parallel the expression of four housekeeping genes—G6PD (GenBank Accession No. NM_000402 (SEQ ID NO:405); G6PD (SEQ ID NO:404) amplicon), RPL19 (GenBank Accession No. NM_000981 (SEQ ID NO:369); RPL19 (SEQ ID NO:368) amplicon), PBGD (GenBank Accession No. BC019323 (SEQ ID NO:381); amplicon—PBGD-amplicon (SEQ ID NO:382)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the normal samples (sample numbers 43, 45, 46, 47, 48, 49, 50, 51, 52, 54, 56, 58, 59, 60, 61, 62, 63, 64, 65, 66, 67, 68 and 69, Table 4_1 above), to obtain a value of fold up-regulation for each sample relative to median of the normal samples.

Figure 41:
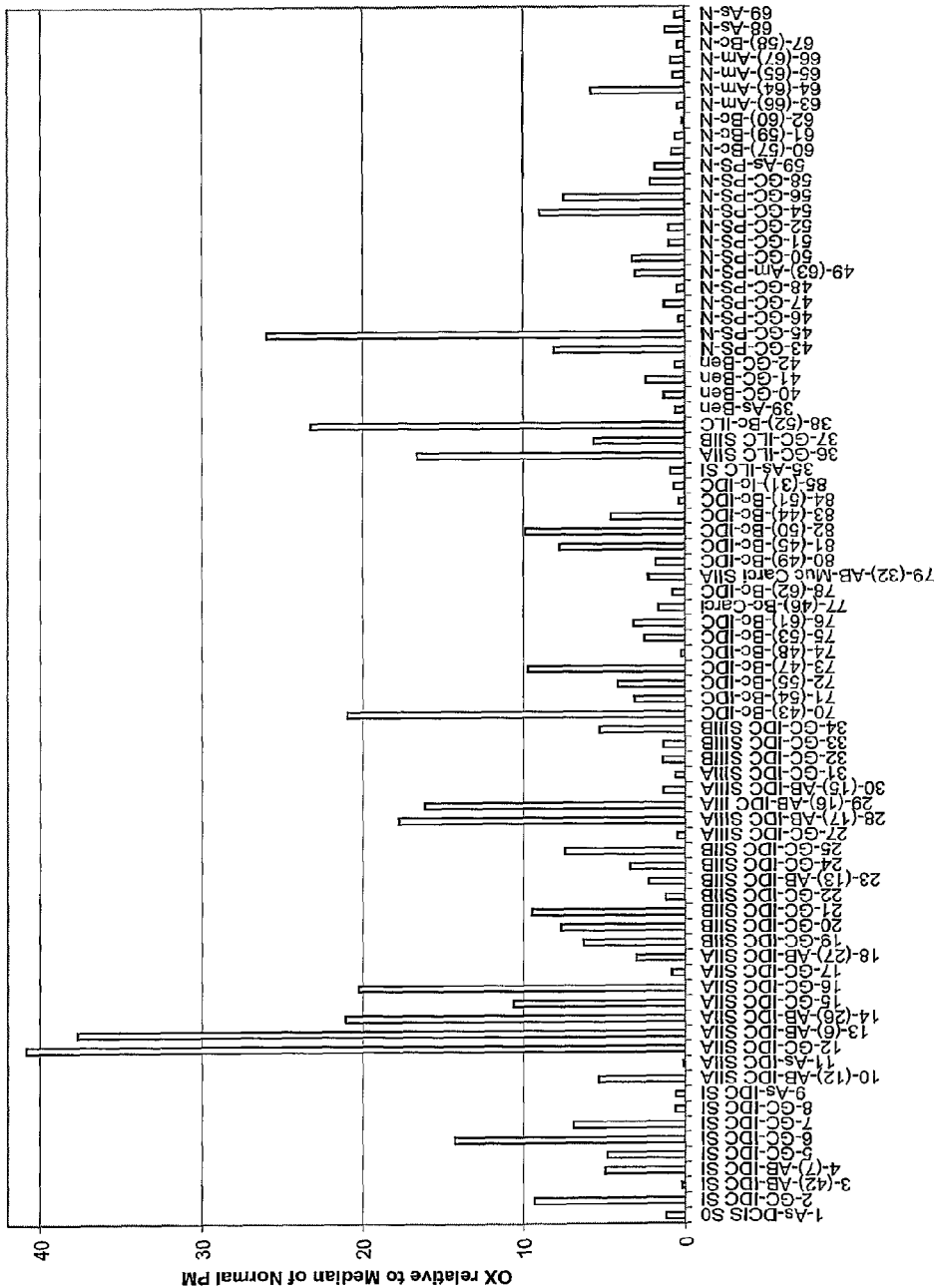
FIG. 41 is a histogram showing Expression of *Homo sapiens* kallikrein 4 ((KLK4) AA336074 transcripts which are detectable by amplicon as depicted in sequence name AA336074_seg13WT (SEQ ID NO:434) in normal and cancerous Breast tissues.

FIG. 41 is a histogram showing over expression of the above-indicated *Homo sapiens* kallikrein 4 (prostase, enamel matrix, prostate) (KLK4) transcripts in cancerous Breast samples relative to the normal samples.

As is evident from FIG. 41, the expression of *Homo sapiens* kallikrein 4 (prostase, enamel matrix, prostate) (KLK4) transcripts detectable by the above amplicon in cancer samples was higher than in the non-cancerous samples (sample numbers 39-43, 45, 46, 47, 48, 49, 50, 51, 52, 54, 56, 58, 59, 60, 61, 62, 63, 64, 65, 66, 67, 68 and 69, Table 4_1 above). Notably an over-expression of at least 10 fold was found in 11 out of 53 adenocarcinoma samples.

Statistical analysis was applied to verify the significance of these results, as described below.

The P value for the difference in the expression levels of *Homo sapiens* kallikrein 4 (prostase, enamel matrix, prostate) (KLK4) transcripts detectable by the above amplicon in Breast cancer samples versus the normal tissue samples was determined by T test as 9.12e-03.

Threshold of 10 fold over expression was found to differentiate between cancer and normal samples with P value of 3.86e-02 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: AA336074_seg13WTF (SEQ ID NO:435) forward primer; and AA336074_seg13WTR (SEQ ID NO:436) reverse primer.

The present invention also preferably encompasses any amplicon obtained through the use of any suitable primer pair; for example, for the above experiment, the following amplicon was obtained as a non-limiting illustrative example only of a suitable amplicon: AA336074_seg13WT (SEQ ID NO:434).

```
Forward Primer (AA336074_seg13WTF (SEQ ID
NO: 435)):
AATGCCTACCGTGCTGCAG

Reverse Primer (AA336074_seg13WTR (SEQ ID
NO: 436)):
CGGCGCAGAACATGCTG

Amplicon (AA336074_seg13WT (SEQ ID NO: 434)):
AATGCCTACCGTGCTGCAGTGCGTGAACGTGTCGGTGGTGTCTGAGGA
GGTCTGCAGTAAGCTCTATGACCCGCTGTACCACCCCAGCATGTTCT
GCGCCG Forward Primer (AA336074_seg13WTF (SEQ ID
NO: 435):
AATGCCTACCGTGCTGCAG Reverse Primer (AA336074_seg13WTR (SEQ ID
NO: 436):
CGGCGCAGAACATGCTG Amplicon (AA336074_seg13WT (SEQ ID NO: 434:
AATGCCTACCGTGCTGCAGTGCGTGAACGTGTCGGTGGTGTCTGAGGAG
GTCTGCAGTAAGCTCTATGACCCGCTGTACCACCCCAGCATGTTCTG
CGCCG
```

Expression of *Homo sapiens* Kallikrein 4 (Prostase, Enamel Matrix, Prostate) (KLK4) AA336074 Transcripts which are Detectable by Amplicon as Depicted in Sequence Name AA336074_seg13WT (SEQ ID NO:434) in Different Normal Tissues Expression of *Homo sapiens* kallikrein 4 (prostase, enamel matrix, prostate) (KLK4) transcripts detectable by or according to seg13WT—AA336074_seg13WT (SEQ ID NO:434) amplicon and primers AA336074_seg13WTF (SEQ ID NO:435) and AA336074_seg13WTR (SEQ ID NO:436) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), and TATA box (GenBank Accession No. NM_003194 (SEQ ID NO:371); TATA (SEQ ID NO:370) amplicon) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the breast samples (sample numbers 41, 42 and 43, Table 5_1 above), to obtain a value of relative expression of each sample relative to median of the breast samples.

```
Forward Primer (AA336074_seg13WTF (SEQ ID
NO: 435)):
AATGCCTACCGTGCTGCAG

Reverse Primer (AA336074_seg13WTR (SEQ ID
NO: 436)):
CGGCGCAGAACATGCTG

Amplicon (AA336074_seg13WT (SEQ ID NO: 434)):
AATGCCTACCGTGCTGCAGTGCGTGAACGTGTCGGTGGTGTCTGAGGA
GGTCTGCAGTAAGCTCTATGACCCGCTGTACCACCCCAGCATGTTCTG
CGCCG
```

Figure 42:
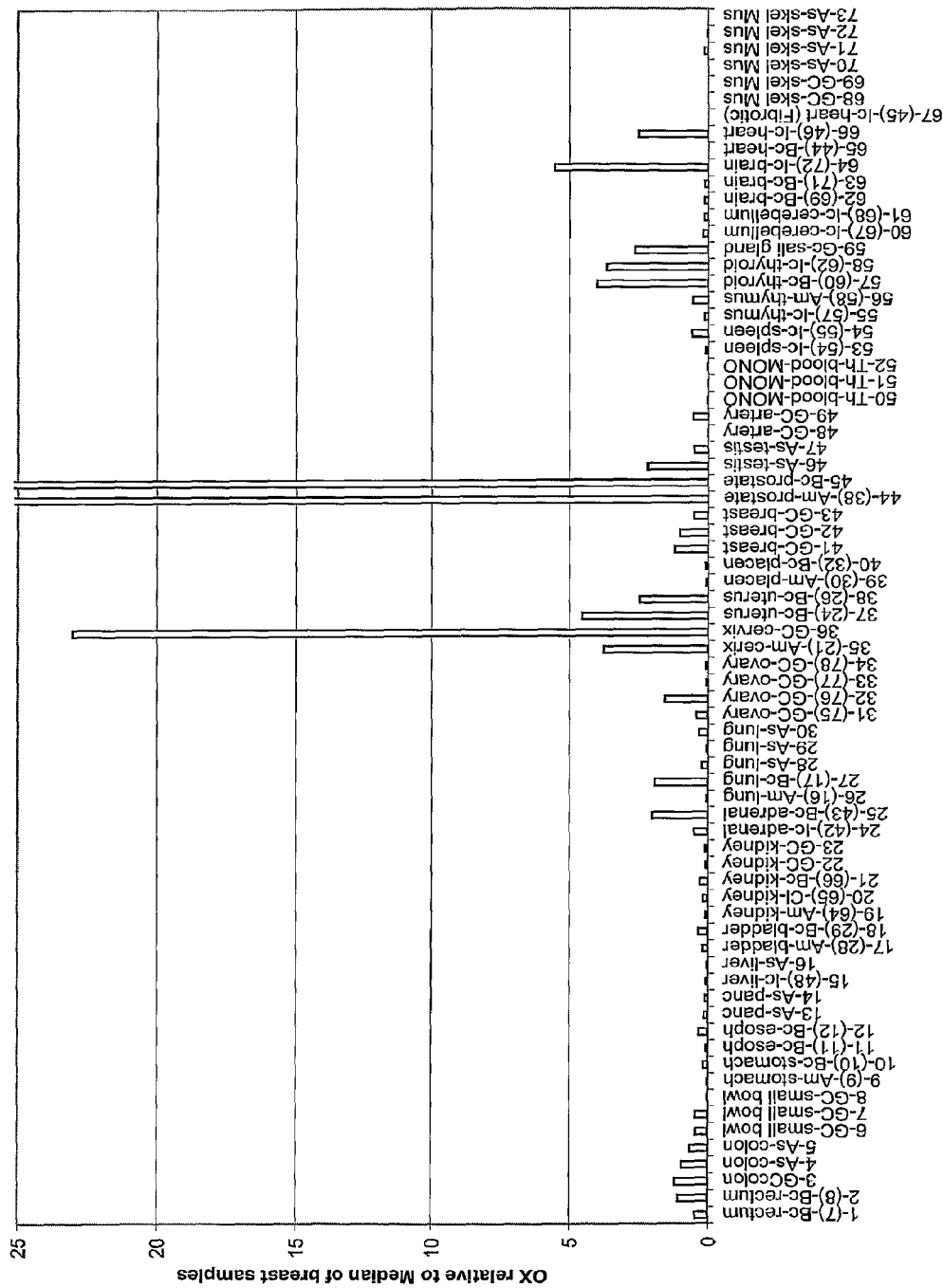
FIG. 42 is a histogram showing over expression of the *Homo sapiens* kallikrein 4 (KLK4) AA336074 transcripts which are detectable by amplicon as depicted in sequence name AA336074_seg13WT (SEQ ID NO:434) in different normal tissues.

FIG. 42 is a histogram showing over expression of the Homo sapiens kallikrein 4 (prostase, enamel matrix, prostate) (KLK4) AA336074 transcripts which are detectable by amplicon as depicted in sequence name AA336074_seg13WT (SEQ ID NO:434) in different normal tissues.

Expression of Homo sapiens Kallikrein 4 (Prostase, Enamel Matrix, Prostate) (KLK4) AA336074 Transcripts which are Detectable by Amplicon as Depicted in Sequence Name AA336074_junc9-28 (SEQ ID NO:431) in Normal and Cancerous Lung Tissues Expression of Homo sapiens kallikrein 4 (prostase, enamel matrix, prostate) (KLK4) transcripts detectable by or according to junc9-28—AA336074_junc9-28 (SEQ ID NO:431) amplicon and primers AA336074_junc9-28F (SEQ ID NO:432) and AA336074_junc9-28R (SEQ ID NO:433) was measured by real time PCR. In parallel the expression of four housekeeping genes—G6PD (GenBank Accession No. NM_000402 (SEQ ID NO:405); G6PD (SEQ ID NO:404) amplicon), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), SDHA (GenBank Accession No. NM_004168 (SEQ ID NO:364); amplicon—SDHA-amplicon (SEQ ID NO:365)) and Ubiquitin (GenBank Accession No. BC000449 (SEQ ID NO:366); amplicon—Ubiquitin-amplicon (SEQ ID NO:367)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold up-regulation for each sample relative to median of the normal PM samples.

Figure 43:
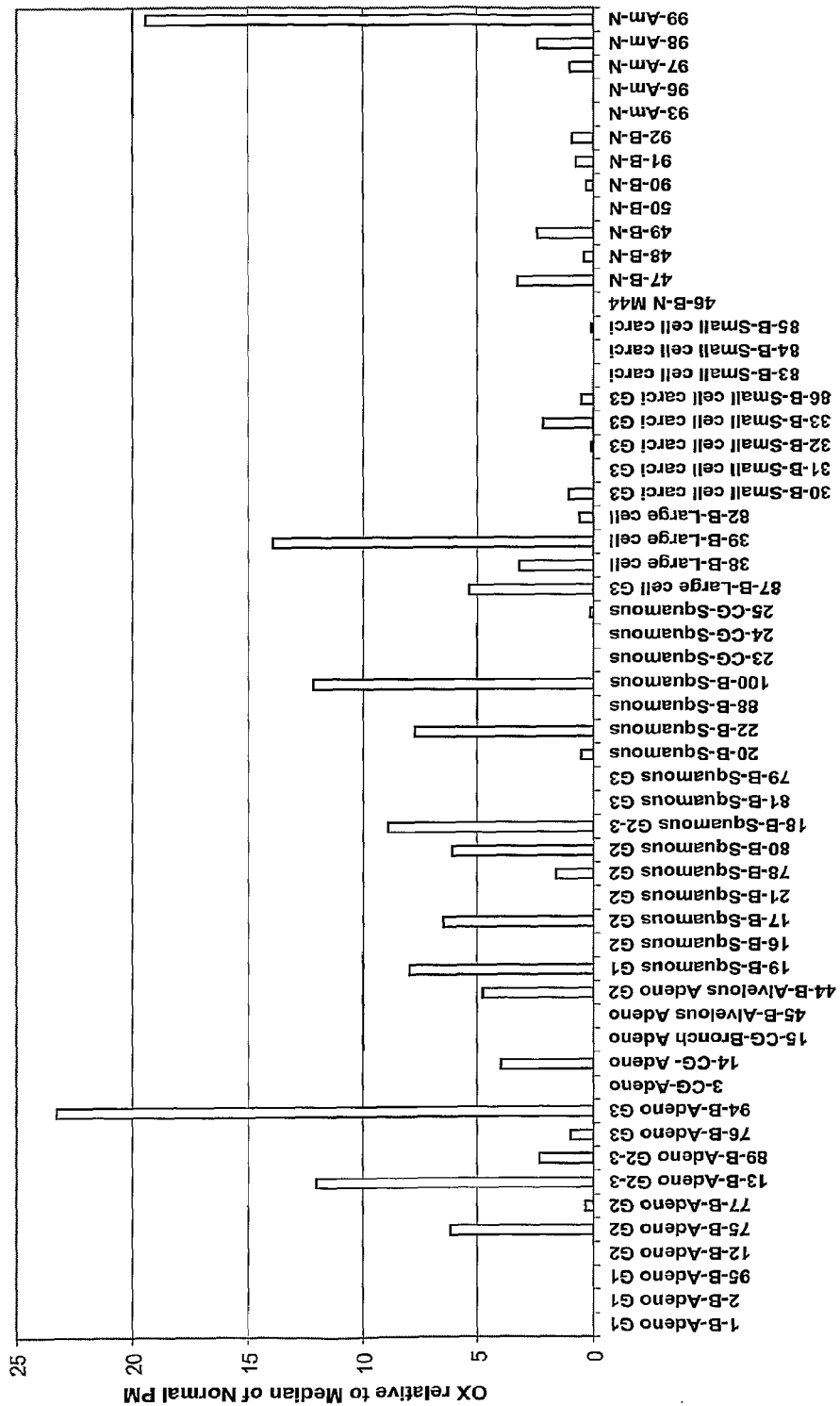
FIG. 43 is a histogram showing over expression of the *Homo sapiens* kallikrein 4 (KLK4) AA336074 transcripts which are detectable by amplicon as depicted in sequence name AA336074 junc 9-28 (SEQ ID NO: 431) in normal and cancerous lung tissues.

FIG. 43 is a histogram showing over expression of the above-indicated Homo sapiens kallikrein 4 (prostase, enamel matrix, prostate) (KLK4) transcripts in cancerous lung samples relative to the normal samples.

As is evident from FIG. 43, the expression of Homo sapiens kallikrein 4 (prostase, enamel matrix, prostate) (KLK4) transcripts detectable by the above amplicon in cancer samples was higher in several cancer samples than in the non-cancerous samples (sample numbers 47, 48, 49, 50, 90, 91, 92, 93, 96, 97, 98 and 99, Table 3 above). Notably an over-expression of at least 5 fold was found in 10 out of 35 non-small cell lung carcinoma samples.

Statistical analysis was applied to verify the significance of these results, as described below.

Threshold of 5 fold over expression was found to differentiate between cancer and normal samples with P value of 4.01e-02 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: AA336074_junc9-28F (SEQ ID NO:432) forward primer; and AA336074_junc9-28R (SEQ ID NO:433) reverse primer.

The present invention also preferably encompasses any amplicon obtained through the use of any suitable primer pair; for example, for the above experiment, the following amplicon was obtained as a non-limiting illustrative example only of a suitable amplicon: AA336074_junc9-28 (SEQ ID NO:431).

```
Forward Primer (AA336074_junc9-28F (SEQ ID
NO: 432)):
CTGCTGGCGAACGATGCT

Reverse Primer (AA336074_junc9-28R (SEQ ID
NO: 433)):
GCCGAAATGGTACAACCCTG

Amplicon (AA336074_junc9-28 (SEQ ID NO: 431)):
CTGCTGGCGAACGATGCTGTGATTGCCATCCAGTCCCAGACTGTGGGAG
GCTGGGAGTGTGAGAAGCTTTCCCAACCCTGGCAGGGTTGTACCAT
TTCGGC
```

Expression of Homo sapiens Kallikrein 4 (Prostase, Enamel Matrix, Prostate) (KLK4) AA336074 Transcripts which are Detectable by Amplicon as Depicted in Sequence Name AA336074_seg31 (SEQ ID NO:437) in Normal and Cancerous Breast Tissues Expression of Homo sapiens kallikrein 4 (prostase, enamel matrix, prostate) (KLK4) transcripts detectable by or according to seg31—AA336074_seg31 (SEQ ID NO:437) amplicon and primers AA336074_seg31F (SEQ ID NO:438) and AA336074_seg31R (SEQ ID NO:439) was measured by real time PCR. In parallel the expression of four housekeeping genes—G6PD (GenBank Accession No. NM_000402 (SEQ ID NO:405); G6PD (SEQ ID NO:404) amplicon), RPL19 (GenBank Accession No. NM_000981 (SEQ ID NO:369); RPL19 (SEQ ID NO:368) amplicon), PBGD (GenBank Accession No. BC019323 (SEQ ID NO:381); amplicon—PBGD-amplicon (SEQ ID NO:382)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the normal samples (sample numbers 43, 45, 46, 47, 48, 49, 50, 51, 52, 54, 56, 58, 59, 60, 61, 62, 63, 64, 65, 66, 67, 68 and 69, Table 4_1 above), to obtain a value of fold up-regulation for each sample relative to median of the normal samples.

Figure 44:
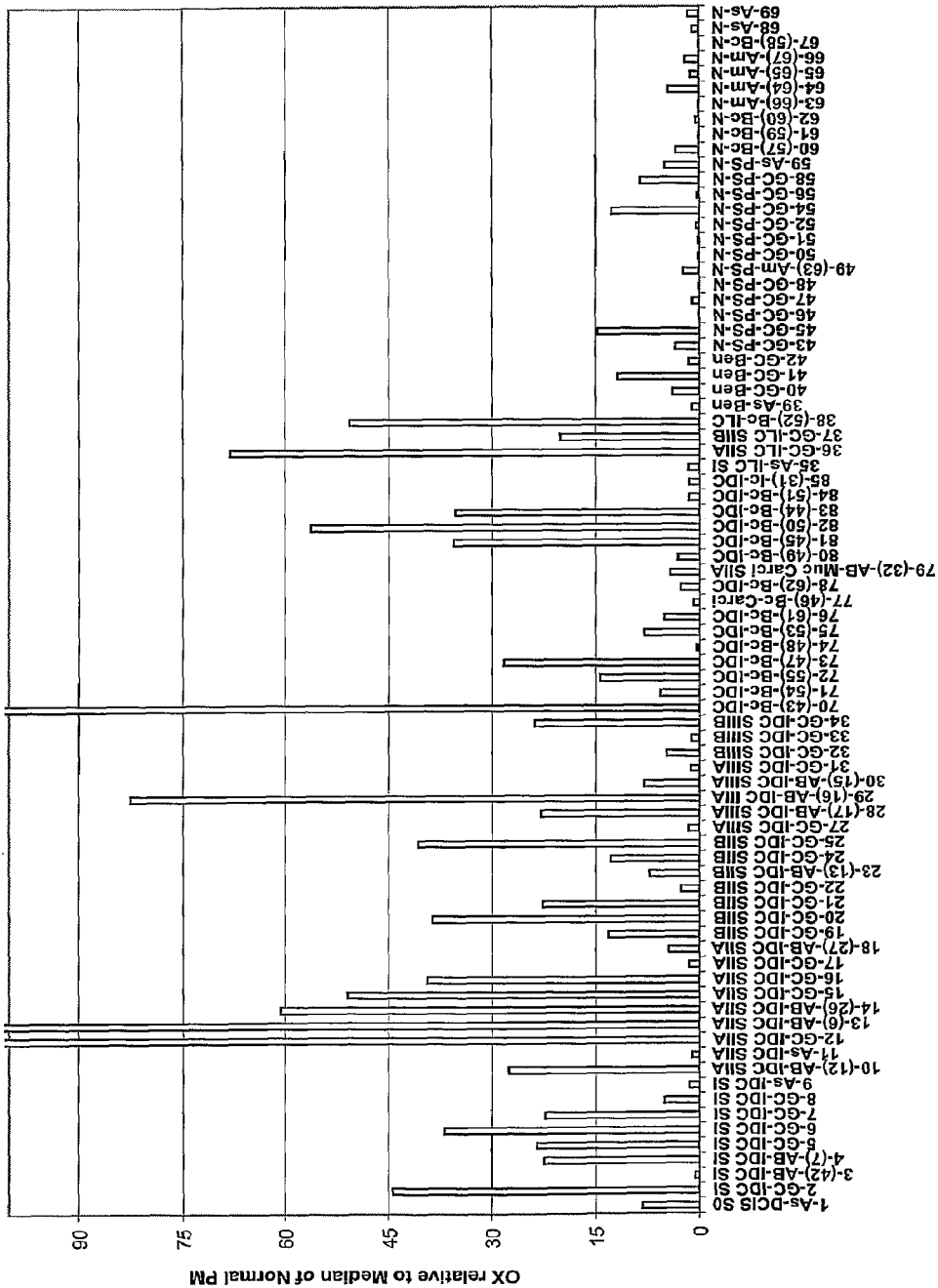
FIG. 44 is a histogram showing over expression of the *Homo sapiens* kallikrein 4 (KLK4) AA336074 transcripts which are detectable by amplicon as depicted in sequence name AA336074 seg31 (SEQ ID NO: 437) in normal and cancerous breast tissues.

FIG. 44 is a histogram showing over expression of the above-indicated *Homo sapiens* kallikrein 4 (prostase, enamel matrix, prostate) (KLK4) transcripts in cancerous Breast samples relative to the normal samples.

As is evident from FIG. 44, the expression of *Homo sapiens* kallikrein 4 (prostase, enamel matrix, prostate) (KLK4) transcripts detectable by the above amplicon in cancer samples was significantly higher than in the non-cancerous samples (sample numbers 39-43, 45, 46, 47, 48, 49, 50, 51, 52, 54, 56, 58, 59, 60, 61, 62, 63, 64, 65, 66, 67, 68 and 69, Table 4_1 above). Notably an over-expression of at least 15 fold was found in 25 out of 53 adenocarcinoma samples.

Statistical analysis was applied to verify the significance of these results, as described below.

The P value for the difference in the expression levels of *Homo sapiens* kallikrein 4 (prostase, enamel matrix, prostate) (KLK4) transcripts detectable by the above amplicon in Breast cancer samples versus the normal tissue samples was determined by T test as 5.54e-05.

Threshold of 15 fold over expression was found to differentiate between cancer and normal samples with P value of 2.49e-06 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: AA336074_seg31F (SEQ ID NO:438) forward primer; and AA336074_seg31R (SEQ ID NO:439) reverse primer.

The present invention also preferably encompasses any amplicon obtained through the use of any suitable primer pair; for example, for the above experiment, the following amplicon was obtained as a non-limiting illustrative example only of a suitable amplicon: AA336074_seg31 (SEQ ID NO:437).

```
Forward Primer (AA336074_seg31F (SEQ ID NO: 438)):
CTGGGTGCAGCCACATGATA

Reverse Primer (AA336074_seg31R (SEQ ID NO: 439)):
CCAGGTGGAAGTCGCTAGGA

Amplicon (AA336074_seg31 (SEQ ID NO: 437)):
CTGGGTGCAGCCACATGATAAAGGAAGGACCGGAGCTTGGTGTAACCCC
TGATCCCTCCTAGATGGGGCTAGGTGGGGCTAGCCTAGATGGGGCTAAG
TCCTAGCGACTTCCACCTGG
```

Expression of *Homo sapiens* Kallikrein 4 (Prostase, Enamel Matrix, Prostate) (KLK4) AA336074 Transcripts which are Detectable by Amplicon as Depicted in Sequence Name AA336074_seg31 (SEQ ID NO:437) in Different Normal Tissues Expression of *Homo sapiens* kallikrein 4 (prostase, enamel matrix, prostate) (KLK4) transcripts detectable by or according to seg31—AA336074_seg31 (SEQ ID NO:437) amplicon and primers AA336074_seg31F (SEQ ID NO:438) and AA336074_seg31R (SEQ ID NO:439) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), and TATA box (GenBank Accession No. NM_003194 (SEQ ID NO:371); TATA (SEQ ID NO:370) amplicon) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the breast samples (sample numbers 41, 42 and 43, Table 5_1 above), to obtain a value of relative expression of each sample relative to median of the breast samples.

```
Forward Primer (AA336074_seg31F (SEQ ID NO: 438)):
CTGGGTGCAGCCACATGATA

Reverse Primer (AA336074_seg31R (SEQ ID NO: 439)):
CCAGGTGGAAGTCGCTAGGA

Amplicon (AA336074_seg31 (SEQ ID NO: 437)):
CTGGGTGCAGCCACATGATAAAGGAAGGACCGGAGCTTGGTGTAACCCC
TGATCCCTCCTAGATGGGGCTAGGTGGGGCTAGCCTAGATGGGGCTAAG
TCCTAGCGACTTCCACCTGG
```

Figure 45:
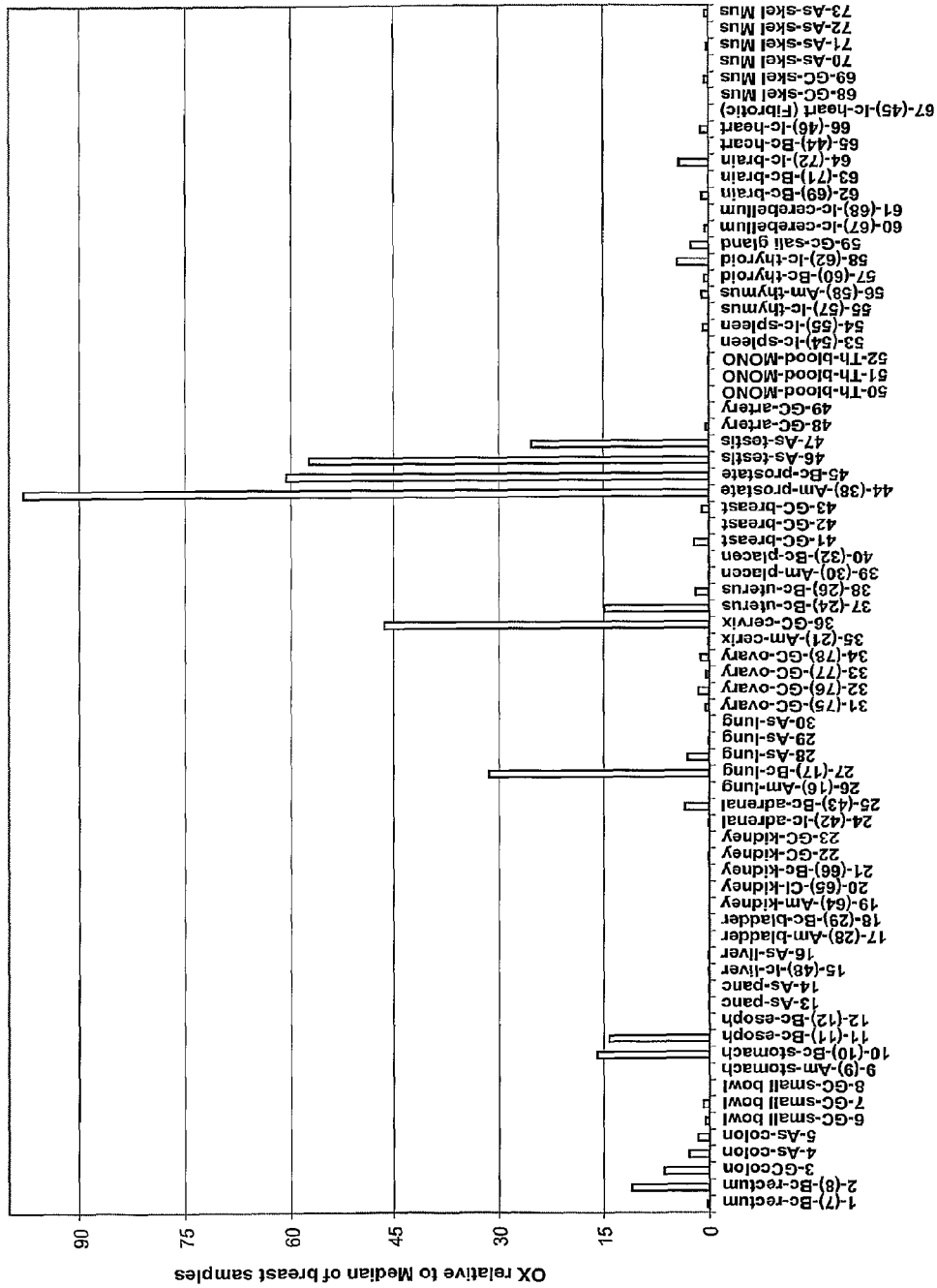
FIG. 45 is a histogram showing over expression of the *Homo sapiens* kallikrein 4 (prostase, enamel matrix, prostate) (KLK4) AA336074 transcripts which are detectable by amplicon as depicted in sequence name AA336074_seg31 (SEQ ID NO:437) in different normal tissues.

FIG. 45 is a histogram showing over expression of the *Homo sapiens* kallikrein 4 (prostase, enamel matrix, prostate) (KLK4) AA336074 transcripts which are detectable by amplicon as depicted in sequence name AA336074_seg31 (SEQ ID NO:437) in different normal tissues.

*Homo sapiens* kallikrein 4 ((KLK4) AA336074 transcripts which are detectable by amplicon as depicted in sequence name AA336074_junc9-28 (SEQ ID NO:431) and primers AA336074_junc9-28F (SEQ ID NO:432) and AA336074_junc9-28R (SEQ ID NO:433) did not show any differential expression in one experiment carried out with each of the following cancer panels: colon cancer and ovary cancer.

*Homo sapiens* kallikrein 4 ((KLK4) AA336074 transcripts which are detectable by amplicon as depicted in sequence name AA336074_seg31 (SEQ ID NO:437) and primers AA336074_seg31F (SEQ ID NO:438) and AA336074_seg31R (SEQ ID NO:439) did not show any differential expression in one experiment carried out with each of the following cancer panels: colon cancer, lung cancer and ovary cancer.

Description for Cluster HUMTREFAC

Cluster HUMTREFAC features 1 transcript(s) and 6 segment(s) of interest, the names for which are given in Tables 252 and 253, respectively. The selected protein variants are given in table 254.

TABLE 252

Transcripts of interest
Transcript Name

| HUMTREFAC_T3 (SEQ ID NO: 244) |
|---|

TABLE 253

Segments of interest
Segment Name

| HUMTREFAC_N0 (SEQ ID NO: 246) |
|---|
| HUMTREFAC_N9 (SEQ ID NO: 251) |
| HUMTREFAC_N3 (SEQ ID NO: 247) |
| HUMTREFAC_N4 (SEQ ID NO: 248) |
| HUMTREFAC_N5 (SEQ ID NO: 249) |
| HUMTREFAC_N8 (SEQ ID NO: 250) |

TABLE 254

Proteins of interest

| Protein Name | Corresponding Transcript(s) |
|---|---|
| HUMTREFAC_P9 (SEQ ID NO: 245) | HUMTREFAC_T3 (SEQ ID NO: 244) |

These sequences are variants of the known protein Trefoil factor 3 precursor (SwissProt accession identifier TFF3_HUMAN (SEQ ID NO:440); known also according to the synonyms Intestinal trefoil factor; hP1.B), referred to herein as the previously known protein.

Protein Trefoil factor 3 precursor is known or believed to have the following function(s): May have a role in promoting cell migration (motogen). Known polymorphisms for this sequence are as shown in Table 255.

TABLE 255

Amino acid mutations for Known Protein

| SNP position(s) on amino acid sequence | Comment |
|---|---|
| 74-76 | QEA -> TRKT |

Protein Trefoil factor 3 precursor localization is believed to be Secreted.

The following GO Annotation(s) apply to the previously known protein. The following annotation(s) were found: defense response; digestion, which are annotation(s) related to Biological Process; and extracellular region, which are annotation(s) related to Cellular Component.

The GO assignment relies on information from one or more of the SwissProt/TremBl Protein knowledgebase or Locuslink.

Cluster HUMTREFAC can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 46 refer to weighted expression of ESTs in each category, as "parts per million" (ratio of the expression of ESTs for a particular cluster to the expression of all ESTs in that category, according to parts per million).

Figure 46:
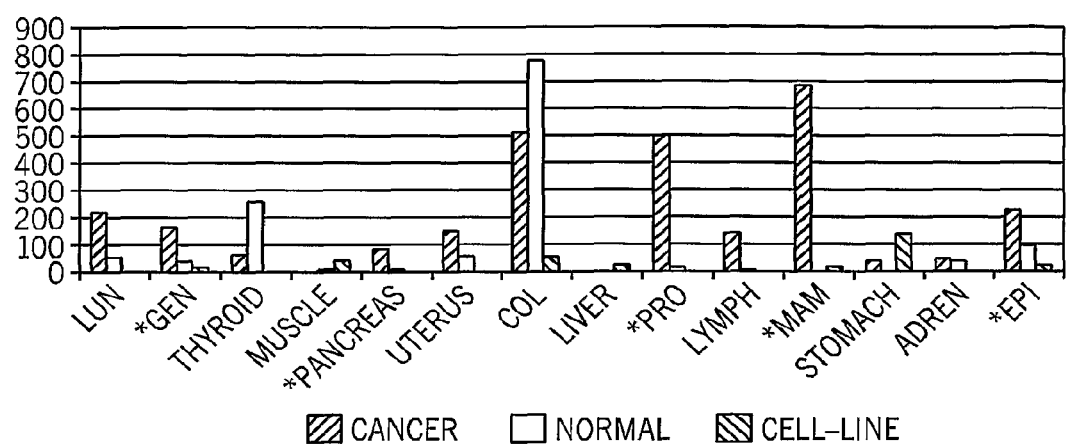
FIG. 46 shows that cluster HUMTREFAC is overexpressed (at least at a minimum level) in the following pathological conditions: a mixture of malignant tumors from different tissues, pancreas carcinoma, prostate cancer, breast malignant tumors and epithelial malignant tumors.

Overall, the following results were obtained as shown with regard to the histograms in FIG. 39 and Table 256. FIG. 46 shows that cluster HUMTREFAC is overexpressed (at least at a minimum level) in the following pathological conditions: a mixture of malignant tumors from different tissues, pancreas carcinoma, prostate cancer, breast malignant tumors and epithelial malignant tumors.

TABLE 256

Normal tissue distribution

| Name of Tissue | Number |
|---|---|
| lung | 54 |
| general | 38 |
| Thyroid | 255 |
| muscle | 3 |
| pancreas | 2 |
| uterus | 53 |
| colon | 772 |
| liver | 0 |
| prostate | 15 |

TABLE 256-continued

Normal tissue distribution

| Name of Tissue | Number |
|---|---|
| lymph nodes | 3 |
| breast | 0 |
| stomach | 0 |
| adrenal | 39 |
| epithelial | 94 |

TABLE 257

P values and ratios for expression in cancerous tissue

| Name of Tissue | P1 | P2 | SP1 | R3 | SP2 | R4 |
|---|---|---|---|---|---|---|
| lung | 4.3e-01 | 7.2e-01 | 3.9e-03 | 1.1 | 2.0e-01 | 0.5 |
| general | 8.3e-05 | 2.0e-02 | 4.7e-28 | 3.5 | 3.0e-10 | 1.9 |
| Thyroid | 6.9e-01 | 6.9e-01 | 9.7e-01 | 0.5 | 9.7e-01 | 0.5 |
| muscle | 9.2e-01 | 4.8e-01 | N/A | N/A | 4.0e-01 | 2.1 |
| pancreas | 9.7e-02 | 2.1e-01 | 5.7e-03 | 6.5 | 2.1e-02 | 4.6 |
| uterus | 3.6e-01 | 6.9e-01 | 7.3e-02 | 1.3 | 4.0e-01 | 0.8 |
| colon | 1.8e-01 | 2.5e-01 | 9.6e-01 | 0.5 | 1.0e+00 | 0.4 |
| liver | N/A | 6.9e-01 | N/A | N/A | 7.0e-01 | 1.4 |
| prostate | 1.1e-01 | 2.1e-01 | 1.3e-09 | 7.8 | 3.7e-07 | 5.5 |
| lymph nodes | 5.8e-01 | 8.2e-01 | 2.3e-02 | 5.0 | 1.9e-01 | 2.1 |
| breast | 7.6e-02 | 1.5e-01 | 2.7e-06 | 12.2 | 1.0e-03 | 6.5 |
| stomach | 2.7e-01 | 1.0e-01 | 5.0e-01 | 2.0 | 6.5e-02 | 2.8 |
| adrenal | 6.1e-01 | 6.6e-01 | 7.0e-01 | 1.1 | 7.8e-01 | 0.9 |
| epithelial | 9.5e-03 | 2.2e-01 | 1.0e-09 | 2.0 | 4.9e-02 | 1.1 |

As noted above, cluster HUMTREFAC features 1 transcript(s), which were listed in Table 252 above. These transcript(s) encode for protein(s) which are variant(s) of protein Trefoil factor 3 precursor. A description of each variant protein according to the present invention is now provided.

Variant protein HUMTREFAC_P9 (SEQ ID NO:245) according to the present invention has an amino acid sequence as given at the end of the application; it is encoded by transcript(s) HUMTREFAC_T3 (SEQ ID NO:244).

The localization of the variant protein was determined according to results from a number of different software programs and analyses, including analyses from SignalP and other specialized programs. The variant protein is secreted.

Variant protein HUMTREFAC_P9 (SEQ ID NO:245) also has the following non-silent SNPs (Single Nucleotide Polymorphisms) as listed in Table 258, (given according to their position(s) on the amino acid sequence, with the alternative amino acid(s) listed; the presence of known SNPs in variant protein HUMTREFAC_P9 (SEQ ID NO:245) sequence provides support for the deduced sequence of this variant protein according to the present invention).

TABLE 258

Amino acid mutations

| SNP position(s) on amino acid sequence | Alternative amino acid(s) |
|---|---|
| 5 | A -> S |
| 5 | A -> T |
| 14 | A -> V |
| 60 | P -> S |
| 102 | P -> |
| 123 | S -> * |

Variant protein HUMTREFAC_P9 (SEQ ID NO:245) is encoded by the following transcript(s): HUMTREFAC_T3 (SEQ ID NO:244), for which the coding portion starts at position 278 and ends at position 688. The transcript also has the following SNPs as listed in Table 259 (given according to their position on the nucleotide sequence, with the alternative nucleic acid listed; the presence of known SNPs in variant protein HUMTREFAC_P9 (SEQ ID NO:245) sequence provides support for the deduced sequence of this variant protein according to the present invention).

TABLE 259

| Nucleic acid SNPs | |
|---|---|
| Polymorphism | SNP position(s) on nucleotide sequence |
| A -> G | 233 |
| G -> A | 290 |
| G -> T | 290, 589 |
| C -> T | 318, 455, 404, 685 |
| C -> | 583 |
| C -> A | 645 |

1. Comparison report between HUMTREFAC_P9 (SEQ ID NO:245) and TFF3_HUMAN (SEQ ID NO:440):

A. An isolated chimeric polypeptide as set forth in HUMTREFAC_P9 (SEQ ID NO:245), comprising a first amino acid sequence being at least 90% homologous to MAARALCMLGLVLALLSSSSAEEYVGLS corresponding to amino acids 1-28 of TFF3_HUMAN (SEQ ID NO:440), which also corresponds to amino acids 1-28 of HUMTREFAC_P9 (SEQ ID NO:245), and a second amino acid sequence being at least 70%, optionally at least 80%, preferably at least 85%, more preferably at least 90% and most preferably at least 95% homologous to a polypeptide having the sequence QQGLWQLTGLCLGQLQTSVPCQPRTGWTAATPMSPPRSATTGAAALTPGSLECLGVSSPCRKQNAPSEAPPAA PGRGMRGSEHPCPAVIAARHCSSQLFCPFAPGKRFC (SEQ ID NO: 501) corresponding to amino acids 29-137 of HUMTREFAC_P9 (SEQ ID NO:245), wherein said first amino acid sequence and second amino acid sequence are contiguous and in a sequential order.

B. An isolated polypeptide encoding for an edge portion of HUMTREFAC_P9 (SEQ ID NO:245), comprising an amino acid sequence being at least 70%, optionally at least about 80%, preferably at least about 85%, more preferably at least about 90% and most preferably at least about 95% homologous to the sequence QQGLWQLTGLCLGQLQTSVPCQPRTGWTAATPMSPPRSATTGAAALTPGSLECLGVSSPCRKQNAPSEAPPAA PGRGMRGSEHPCPAVIAARHCSSQLFCPFAPGKRFC (SEQ ID NO: 501) of HUMTREFAC_P9 (SEQ ID NO:245).

2. Comparison report between HUMTREFAC_P9 (SEQ ID NO:245) and Q96NX0_HUMAN (SEQ ID NO: 554):

A. An isolated chimeric polypeptide as set forth in HUMTREFAC_P9 (SEQ ID NO:245), comprising a first amino acid sequence being at least 70%, optionally at least 80%, preferably at least 85%, more preferably at least 90% and most preferably at least 95%, homologous to a polypeptide having the sequence MAARALCMLGLVLALLSSS-SAEEYVGLSQQGLWQLTGLCLGQLQTS-VPCQPRTGWTAATPMSPPRSATTGAA ALTPGSLECL (SEQ ID NO: 591) corresponding to amino acids 29-137 of HUMTREFAC_P9 (SEQ ID NO:245), and a second amino acid sequence being at least 90% homologous to ANQCAV-PAKDRVDCGYPHVTPKE corresponding to amino acids 51-78 of Q96NX0_HUMAN (SEQ ID NO: 554), which also corresponds to amino acids 1-28 of HUMTREFAC_P9 (SEQ ID NO:245), wherein said first amino acid sequence and second amino acid sequence are contiguous and in a sequential order.

B. An isolated polypeptide encoding for a head of HUMTREFAC_P9 (SEQ ID NO:245), comprising a polypeptide being at least 70%, optionally at least about 80%, preferably at least about 85%, more preferably at least about 90% and most preferably at least about 95% homologous to the sequence MAARALCMLGLVLALLSSS-SAEEYVGLSQQGLWQLTGLCLGQLQTS-VPCQPRTGWTAATPMSPPRSATTGAA ALTPGSLECL (SEQ ID NO: 591) of HUMTREFAC_P9 (SEQ ID NO:245).

C. An isolated chimeric polypeptide encoding for an edge portion of HUMTREFAC_P9 (SEQ ID NO:245), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 137−x to 137; and ending at any of amino acid numbers 1+((n−2)−x), in which x varies from 0 to n−2.

Figure 47:
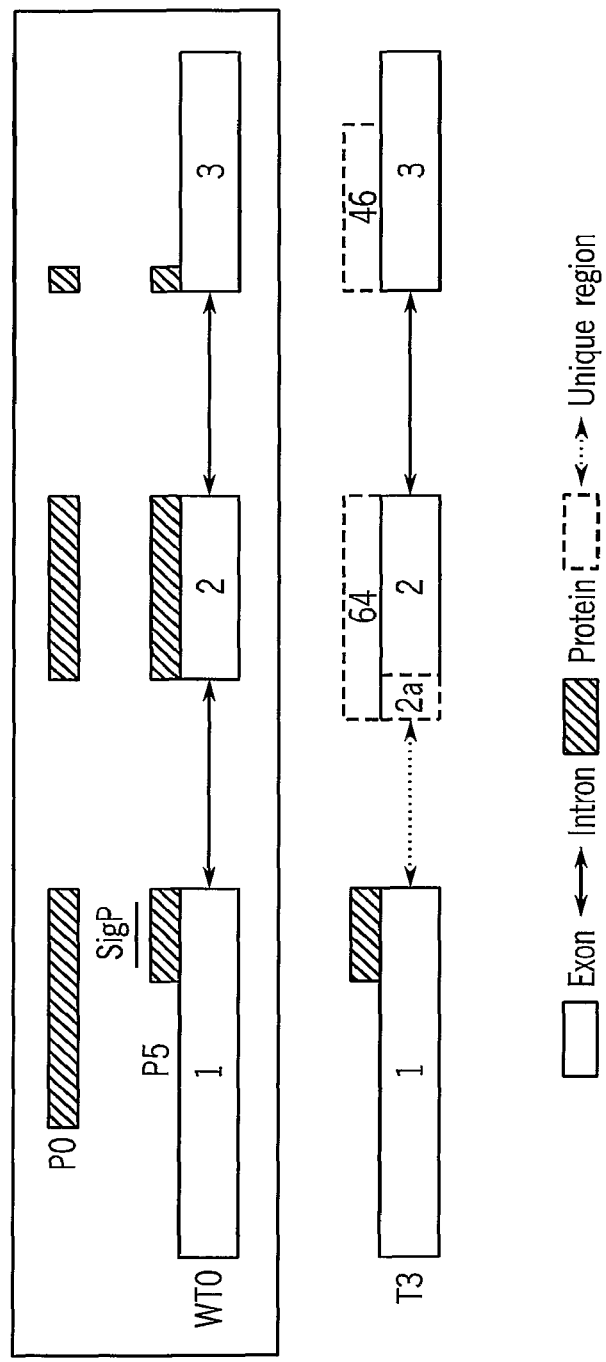
FIG. 47 shows mRNA and protein structure of HUMTREFAC variants. Exons are represented by white boxes, while introns are represented by two headed arrows. Proteins are shown in boxes with upper right to lower left fill. The unique regions are represented by white boxes with dashed frame.

FIG. 47 shows mRNA and protein structure of HUMTREFAC variants. Exons are represented by white boxes, while introns are represented by two headed arrows. Proteins are shown in boxes with upper right to lower left fill. The unique regions are represented by white boxes with dashed frame.

Description for Cluster Z22012

Cluster Z22012 features 2 transcript(s) and 49 segment(s) of interest, the names for which are given in Tables 260 and 261, respectively. The selected protein variants are given in table 262.

TABLE 260

Transcripts of interest
Transcript Name

Z22012_T24 (SEQ ID NO: 252)

Z22012_T32 (SEQ ID NO: 253)

TABLE 261

Segments of interest
Segment Name

Z22012_N0 (SEQ ID NO: 256)

Z22012_N34 (SEQ ID NO: 274)

Z22012_N40 (SEQ ID NO: 279)

Z22012_N41 (SEQ ID NO: 280)

Z22012_N62 (SEQ ID NO: 301)

Z22012_N1 (SEQ ID NO: 257)

Z22012_N2 (SEQ ID NO: 258)

Z22012_N3 (SEQ ID NO: 259)

Z22012_N9 (SEQ ID NO: 260)

Z22012_N10 (SEQ ID NO: 261)

Z22012_N15 (SEQ ID NO: 262)

Z22012_N16 (SEQ ID NO: 263)

TABLE 261-continued

Segments of interest
Segment Name

Z22012_N17 (SEQ ID NO: 264)

Z22012_N18 (SEQ ID NO: 265)

Z22012_N19 (SEQ ID NO: 266)

Z22012_N22 (SEQ ID NO: 267)

Z22012_N23 (SEQ ID NO: 268)

Z22012_N29 (SEQ ID NO: 269)

Z22012_N30 (SEQ ID NO: 270)

Z22012_N31 (SEQ ID NO: 271)

Z22012_N32 (SEQ ID NO: 272)

Z22012_N33 (SEQ ID NO: 273)

Z22012_N35 (SEQ ID NO: 275)

Z22012_N37 (SEQ ID NO: 276)

Z22012_N38 (SEQ ID NO: 277)

Z22012_N39 (SEQ ID NO: 278)

Z22012_N42 (SEQ ID NO: 281)

Z22012_N43 (SEQ ID NO: 282)

Z22012_N44 (SEQ ID NO: 283)

Z22012_N45 (SEQ ID NO: 284)

Z22012_N46 (SEQ ID NO: 285)

Z22012_N47 (SEQ ID NO: 286)

Z22012_N48 (SEQ ID NO: 287)

Z22012_N49 (SEQ ID NO: 288)

Z22012_N50 (SEQ ID NO: 289)

Z22012_N51 (SEQ ID NO: 290)

Z22012_N52 (SEQ ID NO: 291)

Z22012_N53 (SEQ ID NO: 292)

Z22012_N54 (SEQ ID NO: 293)

Z22012_N55 (SEQ ID NO: 294)

Z22012_N56 (SEQ ID NO: 295)

Z22012_N57 (SEQ ID NO: 296)

Z22012_N58 (SEQ ID NO: 297)

Z22012_N59 (SEQ ID NO: 298)

Z22012_N60 (SEQ ID NO: 299)

Z22012_N61 (SEQ ID NO: 300)

Z22012_N63 (SEQ ID NO: 302)

Z22012_N64 (SEQ ID NO: 303)

Z22012_N65 (SEQ ID NO: 304)

TABLE 262

Proteins of interest

| Protein Name | Corresponding Transcript(s) |
|---|---|
| Z22012_P41 (SEQ ID NO: 254) | Z22012_T24 (SEQ ID NO: 252) |
| Z22012_P42 (SEQ ID NO: 255) | Z22012_T32 (SEQ ID NO: 253) |

These sequences are variants of the known protein Galectin-3 binding protein precursor (SwissProt accession identifier L3BP_HUMAN (SEQ ID NO: 441); known also according to the synonyms Lectin galactoside-binding soluble 3 binding protein; Mac-2 binding protein; Mac-2 BP; MAC2BP; Tumor-associated antigen 90K), referred to herein as the previously known protein.

Protein Galectin-3 binding protein precursor is known or believed to have the following function(s): Promotes intergrin-mediated cell adhesion. May stimulate host defense against viruses and tumor cells. Protein Galectin-3 binding protein precursor localization is believed to be Secreted and extracellular matrix.

The following GO Annotation(s) apply to the previously known protein. The following annotation(s) were found: cellular defense response; signal transduction, which are annotation(s) related to Biological Process; scavenger receptor activity, which are annotation(s) related to Molecular Function; and extracellular space, which are annotation(s) related to Cellular Component.

The GO assignment relies on information from one or more of the SwissProt/TremBl Protein knowledgebase or Locuslink.

Cluster Z22012 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 48 refer to weighted expression of ESTs in each category, as "parts per million" (ratio of the expression of ESTs for a particular cluster to the expression of all ESTs in that category, according to parts per million).

Figure 48:
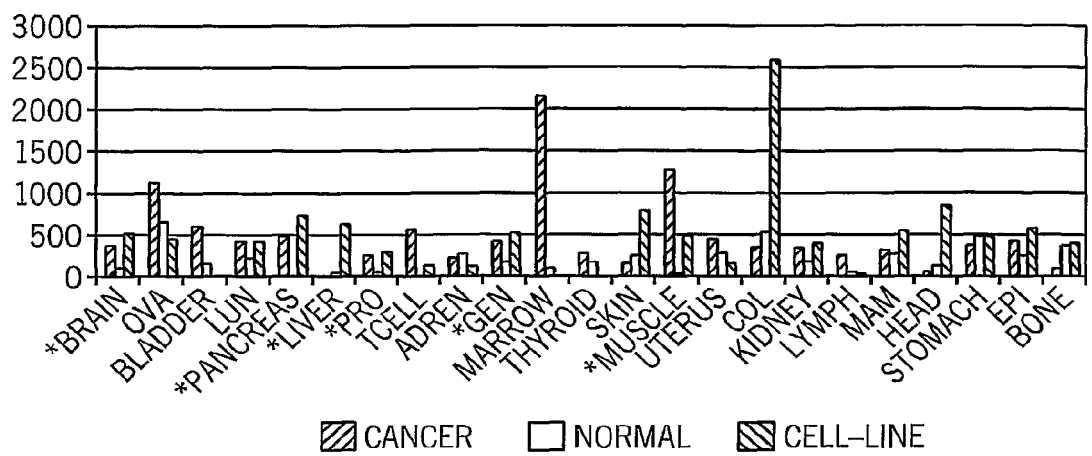
FIG. 48 shows that cluster Z22012 is overexpressed (at least at a minimum level) in the following pathological conditions: brain malignant tumors, pancreas carcinoma, hepatocellular carcinoma, prostate cancer, a mixture of malignant tumors from different tissues and myosarcoma.

Overall, the following results were obtained as shown with regard to the histograms in FIG. 48 and Table 263. FIG. 48 shows that cluster Z22012 is overexpressed (at least at a minimum level) in the following pathological conditions: brain malignant tumors, pancreas carcinoma, hepatocellular carcinoma, prostate cancer, a mixture of malignant tumors from different tissues and myosarcoma.

TABLE 263

Normal tissue distribution

| Name of Tissue | Number |
|---|---|
| brain | 94 |
| ovary | 662 |
| bladder | 164 |
| lung | 229 |
| pancreas | 12 |
| liver | 48 |
| prostate | 49 |
| T cells | 0 |
| adrenal | 277 |
| general | 191 |
| bone marrow | 94 |
| Thyroid | 178 |
| skin | 257 |

TABLE 263-continued

Normal tissue distribution

| Name of Tissue | Number |
|---|---|
| muscle | 41 |
| uterus | 267 |
| colon | 533 |
| kidney | 181 |
| lymph nodes | 54 |
| breast | 285 |
| head and neck | 131 |
| stomach | 469 |
| epithelial | 254 |
| bone | 379 |

TABLE 264

P values and ratios for expression in cancerous tissue

| Name of Tissue | P1 | P2 | SP1 | R3 | SP2 | R4 |
|---|---|---|---|---|---|---|
| brain | 1.6e−01 | 1.4e−01 | 6.6e−09 | 3.2 | 3.4e−18 | 2.7 |
| ovary | 6.4e−01 | 5.6e−01 | 2.2e−02 | 0.6 | 1.4e−01 | 0.6 |
| bladder | 2.0e−01 | 3.6e−01 | 8.1e−03 | 2.7 | 9.8e−02 | 1.7 |
| lung | 9.5e−02 | 1.3e−01 | 1.5e−02 | 1.4 | 4.5e−03 | 1.6 |
| pancreas | 1.7e−02 | 1.2e−02 | 1.7e−12 | 14.7 | 1.5e−16 | 16.4 |
| liver | 9.1e−01 | 4.9e−01 | 1.0e+00 | 0.5 | 7.3e−04 | 4.4 |
| prostate | 1.5e−01 | 2.0e−01 | 1.4e−03 | 3.6 | 4.5e−04 | 3.1 |
| T cells | 5.0e−01 | 3.3e−01 | 3.3e−01 | 3.1 | 5.2e−01 | 1.8 |
| adrenal | 5.9e−01 | 5.1e−01 | 7.1e−01 | 0.7 | 7.8e−01 | 0.7 |
| general | 4.6e−05 | 4.0e−04 | 1.8e−31 | 2.0 | 2.8e−54 | 2.2 |
| bone marrow | 7.6e−01 | 8.6e−01 | 1.6e−08 | 2.9 | 2.2e−02 | 0.7 |
| Thyroid | 6.0e−01 | 6.0e−01 | 4.9e−01 | 1.1 | 4.9e−01 | 1.1 |
| skin | 5.0e−01 | 6.6e−01 | 8.3e−01 | 0.6 | 1.5e−06 | 1.5 |
| muscle | 4.0e−01 | 2.6e−01 | 9.4e−09 | 4.2 | 2.6e−08 | 7.1 |
| uterus | 3.0e−01 | 2.7e−01 | 4.9e−02 | 0.9 | 3.5e−01 | 0.8 |
| colon | 1.3e−01 | 1.6e−01 | 9.4e−01 | 0.6 | 2.6e−03 | 0.5 |
| kidney | 6.2e−01 | 6.6e−01 | 7.5e−02 | 1.4 | 3.4e−02 | 1.4 |
| lymph nodes | 7.4e−01 | 8.4e−01 | 2.3e−02 | 1.5 | 2.7e−01 | 0.8 |
| breast | 7.0e−01 | 7.2e−01 | 3.8e−01 | 0.7 | 1.3e−01 | 1.1 |
| head and neck | 3.4e−01 | 2.5e−01 | 1.0e+00 | 0.7 | 3.4e−02 | 1.6 |
| stomach | 2.4e−01 | 2.0e−01 | 8.0e−01 | 0.3 | 6.4e−01 | 0.8 |
| epithelial | 1.3e−02 | 3.3e−02 | 4.3e−09 | 1.5 | 2.9e−18 | 1.8 |
| bone | 2.4e−01 | 1.5e−01 | 9.9e−01 | 0.4 | 7.6e−01 | 0.7 |

As noted above, cluster Z22012 features 2 transcript(s), which were listed in Table 260 above. These transcript(s) encode for protein(s) which are variant(s) of protein Galectin-3 binding protein precursor. A description of each variant protein according to the present invention is now provided.

Variant protein Z22012_P41 (SEQ ID NO:254) according to the present invention has an amino acid sequence as given at the end of the application; it is encoded by transcript(s) Z22012_T24 (SEQ ID NO:252).

The localization of the variant protein was determined according to results from a number of different software programs and analyses, including analyses from SignalP and other specialized programs. The variant protein is secreted.

Variant protein Z22012_P41 (SEQ ID NO:254) also has the following non-silent SNPs (Single Nucleotide Polymorphisms) as listed in Table 265, (given according to their position(s) on the amino acid sequence, with the alternative amino acid(s) listed; the presence of known SNPs in variant protein Z22012_P41 (SEQ ID NO:254) sequence provides support for the deduced sequence of this variant protein according to the present invention).

TABLE 265

Amino acid mutations

| SNP position(s) on amino acid sequence | Alternative amino acid(s) |
|---|---|
| 9 | V -> M |
| 17 | Q -> |
| 17 | Q -> L |
| 34 | Q -> |
| 68 | E -> * |
| 128 | P -> |
| 135 | G -> |

The glycosylation sites of variant protein Z22012_P41 (SEQ ID NO:254), as compared to the known protein Galectin-3 binding protein precursor, are described in Table 266 (given according to their position(s) on the amino acid sequence in the first column; the second column indicates whether the glycosylation site is present in the variant protein; and the last column indicates whether the position is different on the variant protein).

TABLE 266

Glycosylation site(s)

| Position(s) on known amino acid sequence | Present in variant protein? | Position(s) on variant protein |
|---|---|---|
| 69 | Yes | 69 |
| 125 | Yes | 125 |
| 192 | No | |
| 362 | No | |
| 398 | No | |
| 551 | No | |
| 580 | No | |

Variant protein Z22012_P41 (SEQ ID NO:254) is encoded by the following transcript(s): Z22012_T24 (SEQ ID NO:252), for which the coding portion starts at position 310 and ends at position 777. The transcript also has the following SNPs as listed in Table 267 (given according to their position on the nucleotide sequence, with the alternative nucleic acid listed; the presence of known SNPs in variant protein Z22012_P41 (SEQ ID NO:254) sequence provides support for the deduced sequence of this variant protein according to the present invention).

TABLE 267

Nucleic acid SNPs

| Polymorphism | SNP position(s) on nucleotide sequence |
|---|---|
| A -> | 187, 359, 2230 |
| G -> C | 198, 2270, 2456 |
| G -> T | 198, 511, 1519, 1582, 1819 |
| G -> A | 246, 334, 1602, 2037, 2190, 2257 |
| G -> | 246, 411, 712, 1582, 1602, 2037, 2257 |
| A -> T | 351, 359, 1961 |
| C -> T | 369, 399, 576, 1303, 1446, 1926, 2014, 2118, 2154, 2178, 2295, 2310, 2322, 2406, 2615 |
| C -> | 691, 1345, 1353, 1361, 1433, 1706, 1708 |
| -> G | 841, 1269, 1999 |
| -> C | 852 |
| -> T | 902 |
| C -> A | 1303, 2202, 2216, 2310, |
| C -> G | 1433, 1706, 1708, 2225, 2393 |
| T -> C | 1610, 2477, 2635, |
| T -> | 1610 |
| T -> A | 1739, 2477, 2641 |
| A -> G | 1961, 2433 |
| A -> C | 2546 |
| T -> G | 2641 |

Variant protein Z22012_P42 (SEQ ID NO:255) according to the present invention has an amino acid sequence as given at the end of the application; it is encoded by transcript(s) Z22012_T32 (SEQ ID NO:253).

The localization of the variant protein was determined according to results from a number of different software programs and analyses, including analyses from SignalP and other specialized programs. The variant protein is secreted.

Variant protein Z22012_P42 (SEQ ID NO:255) also has the following non-silent SNPs (Single Nucleotide Polymorphisms) as listed in Table 268, (given according to their position(s) on the amino acid sequence, with the alternative amino acid(s) listed; the presence of known SNPs in variant protein Z22012_P42 (SEQ ID NO:255) sequence provides support for the deduced sequence of this variant protein according to the present invention).

TABLE 268

Amino acid mutations

| SNP position(s) on amino acid sequence | Alternative amino acid(s) |
|---|---|
| 9 | V -> M |
| 17 | Q -> |
| 17 | Q -> L |
| 34 | Q -> |
| 68 | E -> * |
| 175 | C -> |
| 178 | T -> |
| 181 | P -> |
| 205 | P -> |
| 205 | P -> A |

The glycosylation sites of variant protein Z22012_P42 (SEQ ID NO:255), as compared to the known protein Galectin-3 binding protein precursor, are described in Table 269 (given according to their position(s) on the amino acid sequence in the first column; the second column indicates whether the glycosylation site is present in the variant protein; and the last column indicates whether the position is different on the variant protein).

TABLE 269

Glycosylation site(s)

| Position(s) on known amino acid sequence | Present in variant protein? | Position(s) on variant protein |
|---|---|---|
| 69 | Yes | 69 |
| 125 | Yes | 125 |
| 192 | No | |
| 362 | No | |
| 398 | No | |
| 551 | No | |
| 580 | No | |

Variant protein Z22012_P42 (SEQ ID NO:255) is encoded by the following transcript(s): Z22012_T32 (SEQ ID NO:253), for which the coding portion starts at position 310 and ends at position 924. The transcript also has the following SNPs as listed in Table 270 (given according to their position on the nucleotide sequence, with the alternative nucleic acid listed; the presence of known SNPs in variant protein Z22012_P42 (SEQ ID NO:255) sequence provides support for the deduced sequence of this variant protein according to the present invention).

TABLE 270

Nucleic acid SNPs

| Polymorphism | SNP position(s) on nucleotide sequence |
|---|---|
| A -> | 187, 359, 1719 |
| G -> C | 198, 1759, 1945 |
| G -> T | 198, 511, 1008, 1071, 1308 |
| G -> A | 246, 334, 1091, 1526, 1679, 1746 |
| G -> | 246, 411, 1071, 1091, 1488, 1526, 1746 |
| A -> T | 351, 359, 1450 |
| C -> T | 369, 399, 576, 792, 935, 1503, 1607, 1643, 1667, 1784, 1415, 1799, 1811, 1895, 2104 |
| -> G | 758 |
| C -> A | 792, 1691, 1705, 1799 |
| C -> | 834, 842, 850, 922, 1195, 1197 |
| C -> G | 922, 1195, 1197, 1714, 1882 |
| T -> C | 1099, 1966, 2124 |
| T -> | 1099 |
| T -> A | 1228, 1966, 2130 |
| A -> G | 1450, 1922 |
| A -> C | 2035 |
| T -> G | 2130 |

1. Comparison report between Z22012_P41 (SEQ ID NO:254) and L3BP_HUMAN (SEQ ID NO: 441):

A. An isolated chimeric polypeptide as set forth in Z22012_P41 (SEQ ID NO:254), comprising a first amino acid sequence being at least 90% homologous to MTPPRLF-WVWLLVAGTQGVNDGDMRLADGGAT-NQGRVEIFYRGQWGTVCDNLWDLTDASV-VCRALGFENA TQALGRAAFGQGSGPIMLDEVQCTGTEA-SLADCKSLGWLKSNCRHERDAGVVCTN corresponding to amino acids 1-125 of L3BP_HUMAN (SEQ ID NO: 441), which also corresponds to amino acids 1-125 of Z22012_P41 (SEQ ID NO:254), and a second amino acid sequence being at least 70%, optionally at least 80%, preferably at least 85%, more preferably at least 90% and most preferably at least 95% homologous to a polypeptide having the sequence GAPTPWTSPGSSRRPLARSLTAS-GAATCPSA (SEQ ID NO: 499) corresponding to amino acids 126-156 of Z22012_P41 (SEQ ID NO:254), wherein said first amino acid sequence and second amino acid sequence are contiguous and in a sequential order.

B. An isolated polypeptide encoding for an edge portion of Z22012_P41 (SEQ ID NO:254), comprising an amino acid sequence being at least 70%, optionally at least about 80%, preferably at least about 85%, more preferably at least about 90% and most preferably at least about 95% homologous to the sequence GAPTPWTSPGSSRRPLARSLTAS-GAATCPSA (SEQ ID NO: 499) of Z22012_P41 (SEQ ID NO:254).

2. Comparison report between Z22012_P41 (SEQ ID NO:254) and NP_005558 (SEQ ID NO: 551):

A. An isolated chimeric polypeptide as set forth in Z22012_P41 (SEQ ID NO:254), comprising a first amino acid sequence being at least 70%, optionally at least 80%, preferably at least 85%, more preferably at least 90% and most preferably at least 95%, homologous to a polypeptide having the sequence MTPPRLF-WVWLLVAGTQGVNDGDMRLADGGAT-NQGRVEIFYRGQWGTVCDNLWDLTDASV-VCRALGFENA TQALGRAAFGQGSGPIMLDEVQCTGTEA-SLADCKSLGWLKSNCRHERDAGVVCT-NGAPTPWTSPGSSRRPLA RSLTASGAATCPSA (SEQ ID NO: 589) corresponding to amino acids 126-156 of Z22012_P41 (SEQ ID NO:254), and a second amino acid sequence being at least 90% homologous to FQTPQHPS- FLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD corresponding to amino acids 1-125 of NP_005558 (SEQ ID NO: 551), which also corresponds to amino acids 1-125 of Z22012_P41 (SEQ ID NO:254), wherein said first amino acid sequence and second amino acid sequence are contiguous and in a sequential order.

B. An isolated polypeptide encoding for a head of Z22012_P41 (SEQ ID NO:254), comprising a polypeptide being at least 70%, optionally at least about 80%, preferably at least about 85%, more preferably at least about 90% and most preferably at least about 95% homologous to the sequence MTPPRLFWVWLLVAGTQGVNDGDMRLADGGATNQGRVEIFYRGQWGTVCDNLWDLTDASVVCRALGFENA TQALGRAAFGQGSGPIMLDEVQCTGTEASLADCKSLGWLKSNCRHERDAGVVCTNGAPTPWTSPGSSRRPLA RSLTASGAATCPSA (SEQ ID NO: 589) of Z22012_P41 (SEQ ID NO:254).

1. Comparison report between Z22012_P42 (SEQ ID NO:255) and L3BP_HUMAN (SEQ ID NO: 441):

A. An isolated chimeric polypeptide as set forth in Z22012_P42 (SEQ ID NO:255), comprising a first amino acid sequence being at least 70%, optionally at least 80%, preferably at least 85%, more preferably at least 90% and most preferably at least 95%, homologous to a polypeptide having the sequence MTPPRLFWVWLLVAGTQGVNDGDMRLADGGATNQGRVEIFYRGQWGTVCDNLWDLTDASVVCRALGFENA TQALGRAAFGQGSGPIMLDEVQCTGTEASLADCKSLGWLKSNCRHERDAGVVCTNGTSTPEGLTSPCRQSSAS TSWPLPMGPGSCRATAQASLPSSSPRTPRSRCPWTCMPMQWPQGTPCWRSSAYSSWPGTSRP (SEQ ID NO: 590) corresponding to amino acids 126-205 of Z22012_P42 (SEQ ID NO:255), and a second amino acid sequence being at least 90% homologous to FQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD corresponding to amino acids 1-125 of L3BP_HUMAN (SEQ ID NO: 441), which also corresponds to amino acids 1-125 of Z22012_P42 (SEQ ID NO:255), wherein said first amino acid sequence and second amino acid sequence are contiguous and in a sequential order.

B. An isolated polypeptide encoding for a head of Z22012_P42 (SEQ ID NO:255), comprising a polypeptide being at least 70%, optionally at least about 80%, preferably at least about 85%, more preferably at least about 90% and most preferably at least about 95% homologous to the sequence MTPPRLFWVWLLVAGTQGVNDGDMRLADGGATNQGRVEIFYRGQWGTVCDNLWDLTDASVVCRALGFENA TQALGRAAFGQGSGPIMLDEVQCTGTEASLADCKSLGWLKSNCRHERDAGVVCTNGTSTPEGLTSPCRQSSAS TSWPLPMGPGSCRATAQASLPSSSPRTPRSRCPWTCMPMQWPQGTPCWRSSAYSSWPGTSRP (SEQ ID NO: 590) of Z22012_P42 (SEQ ID NO:255).

2. Comparison report between Z22012_P42 (SEQ ID NO:255) and NP_005558 (SEQ ID NO: 551):

A. An isolated chimeric polypeptide as set forth in Z22012_P42 (SEQ ID NO:255), comprising a first amino acid sequence being at least 90% homologous to MTPPRLFWVWLLVAGTQGVNDGDMRLADGGATNQGRVEIFYRGQWGTVCDNLWDLTDASVVCRALGFENA TQALGRAAFGQGSGPIMLDEVQCTGTEASLADCKSLGWLKSNCRHERDAGVVCTN corresponding to amino acids 1-125 of NP_005558 (SEQ ID NO: 551), which also corresponds to amino acids 1-125 of Z22012_P42 (SEQ ID NO:255), and a second amino acid sequence being at least 70%, optionally at least 80%, preferably at least 85%, more preferably at least 90% and most preferably at least 95% homologous to a polypeptide having the sequence GTSTPEGLTSPCRQSSASTSWPLPMGPGSCRATAQASLPSSSPRTPRSRCPWTCMPMQWPQGTPCWRSSAYSS WPGTSRP (SEQ ID NO: 500) corresponding to amino acids 126-205 of Z22012_P42 (SEQ ID NO:255), wherein said first amino acid sequence and second amino acid sequence are contiguous and in a sequential order.

B. An isolated polypeptide encoding for an edge portion of Z22012_P42 (SEQ ID NO:255), comprising an amino acid sequence being at least 70%, optionally at least about 80%, preferably at least about 85%, more preferably at least about 90% and most preferably at least about 95% homologous to the sequence GTSTPEGLTSPCRQSSASTSWPLPMGPGSCRATAQASLPSSSPRTPRSRCPWTCMPMQWPQGTPCWRSSAYSS WPGTSRP (SEQ ID NO: 500) of Z22012_P42 (SEQ ID NO:255).

Description for Cluster Z39737

Cluster Z39737 features 2 transcript(s) and 31 segment(s) of interest, the names for which are given in Tables 271 and 272, respectively. The selected protein variants are given in table 273.

TABLE 271

Transcripts of interest
Transcript Name

Z39737_T5 (SEQ ID NO: 305)

Z39737_T20 (SEQ ID NO: 306)

TABLE 272

Segments of interest
Segment Name

Z39737_N14 (SEQ ID NO: 320)

Z39737_N20 (SEQ ID NO: 325)

Z39737_N24 (SEQ ID NO: 327)

Z39737_N27 (SEQ ID NO: 328)

Z39737_N38 (SEQ ID NO: 339)

Z39737_N2 (SEQ ID NO: 309)

Z39737_N3 (SEQ ID NO: 310)

Z39737_N4 (SEQ ID NO: 311)

Z39737_N5 (SEQ ID NO: 312)

Z39737_N6 (SEQ ID NO: 313)

Z39737_N7 (SEQ ID NO: 314)

Z39737_N9 (SEQ ID NO: 315)

TABLE 272-continued

Segments of interest
Segment Name

Z39737_N10 (SEQ ID NO: 316)
Z39737_N11 (SEQ ID NO: 317)
Z39737_N12 (SEQ ID NO: 318)
Z39737_N13 (SEQ ID NO: 319)
Z39737_N15 (SEQ ID NO: 321)
Z39737_N16 (SEQ ID NO: 322)
Z39737_N17 (SEQ ID NO: 323)
Z39737_N18 (SEQ ID NO: 324)
Z39737_N21 (SEQ ID NO: 326)
Z39737_N28 (SEQ ID NO: 329)
Z39737_N29 (SEQ ID NO: 330)
Z39737_N30 (SEQ ID NO: 331)
Z39737_N31 (SEQ ID NO: 332)
Z39737_N32 (SEQ ID NO: 333)
Z39737_N33 (SEQ ID NO: 334)
Z39737_N34 (SEQ ID NO: 335)
Z39737_N35 (SEQ ID NO: 336)
Z39737_N36 (SEQ ID NO: 337)
Z39737_N37 (SEQ ID NO: 338)

TABLE 273

Proteins of interest

| Protein Name | Corresponding Transcript(s) |
|---|---|
| Z39737_P9 (SEQ ID NO: 307) | Z39737_T20 (SEQ ID NO: 306) |
| Z39737_P25 (SEQ ID NO: 308) | Z39737_T5 (SEQ ID NO: 305) |

These sequences are variants of the known protein Spondin 2 precursor (SwissProt accession identifier SPO2_HUMAN (SEQ ID NO: 442; known also according to the synonyms Mindin; Differentially expressed in cancerous and noncancerous lung cells 1; DIL-1; UNQ435/PRO866), referred to herein as the previously known protein.

Protein Spondin 2 precursor is known or believed to have the following function(s): Cell adhesion protein that promote adhesion and outgrowth of hippocampal embryonic neurons. Binds directly to bacteria and their components and functions as an opsonin for macrophage phagocytosis of bacteria. Essential in the initiation of the innate immune response and represents a unique pattern-recognition molecule in the ECM for microbial pathogens (By similarity). Known polymorphisms for this sequence are as shown in Table 274.

TABLE 274

Amino acid mutations for Known Protein

| SNP position(s) on amino acid sequence | Comment |
|---|---|
| 40 | P -> L (in dbSNP:922697)./FTId = VAR_019701 |
| 122 | E -> A (in dbSNP:11247975)./FTId = VAR_019702 |
| 242 | L -> V (in dbSNP:2279279)./FTId = VAR_019703 |

Protein Spondin 2 precursor localization is believed to be Secreted; extracellular matrix (By similarity).

Cluster Z39737 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 49 refer to weighted expression of ESTs in each category, as "parts per million" (ratio of the expression of ESTs for a particular cluster to the expression of all ESTs in that category, according to parts per million).

Figure 49:
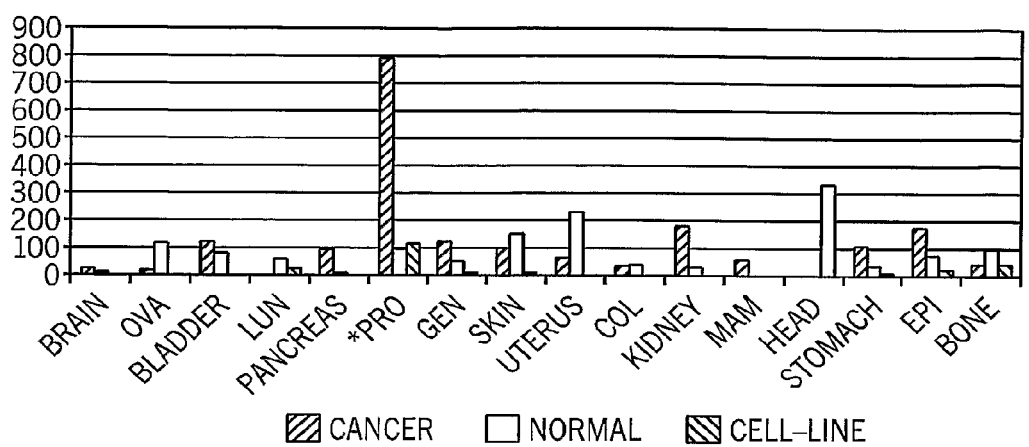
FIG. 49 shows that cluster Z39737 is overexpressed (at least at a minimum level) in the following pathological conditions: prostate cancer.

Overall, the following results were obtained as shown with regard to the histograms in FIG. 49 and Table 275. FIG. 49 shows that cluster Z39737 is overexpressed (at least at a minimum level) in the following pathological conditions: prostate cancer.

TABLE 275

Normal tissue distribution

| Name of Tissue | Number |
|---|---|
| brain | 13 |
| ovary | 116 |
| bladder | 82 |
| lung | 61 |
| pancreas | 10 |
| prostate | 97 |
| general | 51 |
| skin | 152 |
| uterus | 233 |
| colon | 39 |
| kidney | 35 |
| breast | 0 |
| head and neck | 0 |
| stomach | 39 |
| epithelial | 74 |
| bone | 94 |

TABLE 276

P values and ratios for expression in cancerous tissue

| Name of Tissue | P1 | P2 | SP1 | R3 | SP2 | R4 |
|---|---|---|---|---|---|---|
| brain | 1.9e−01 | 3.8e−01 | 3.7e−01 | 1.7 | 7.2e−01 | 0.9 |
| ovary | 8.8e−01 | 8.9e−01 | 9.9e−01 | 0.3 | 1.0e+00 | 0.3 |
| bladder | 7.0e−01 | 7.8e−01 | 4.7e−01 | 1.1 | 7.1e−01 | 0.8 |
| lung | 8.8e−01 | 8.8e−01 | 1.0e+00 | 0.1 | 9.9e−01 | 0.4 |
| pancreas | 1.9e−01 | 3.4e−01 | 1.2e−02 | 3.9 | 4.8e−02 | 2.8 |
| prostate | 1.2e−01 | 1.7e−01 | 2.9e−10 | 4.8 | 1.7e−07 | 3.6 |
| general | 3.3e−02 | 4.1e−01 | 2.8e−12 | 2.0 | 3.8e−03 | 1.2 |
| skin | 7.3e−01 | 8.0e−01 | 8.5e−01 | 0.7 | 1.0e+00 | 0.2 |
| uterus | 7.0e−01 | 8.3e−01 | 1.0e+00 | 0.3 | 1.0e+00 | 0.2 |
| colon | 6.6e−01 | 7.5e−01 | 7.8e−01 | 0.8 | 8.6e−01 | 0.7 |
| kidney | 3.8e−01 | 6.3e−01 | 1.3e−02 | 2.7 | 8.0e−02 | 1.8 |
| breast | 1.1e−01 | 2.2e−01 | 3.2e−01 | 2.5 | 5.6e−01 | 1.7 |
| head and neck | 2.1e−01 | 1.7e−01 | N/A | N/A | 1.4e−01 | 1.6 |
| stomach | 5.8e−01 | 8.4e−01 | 3.1e−01 | 1.4 | 7.3e−01 | 0.8 |
| epithelial | 3.3e−01 | 8.3e−01 | 3.0e−07 | 1.8 | 7.7e−02 | 1.0 |
| bone | 6.6e−01 | 6.7e−01 | 8.7e−01 | 0.6 | 9.3e−01 | 0.6 |

As noted above, cluster Z39737 features 2 transcript(s), which were listed in Table 271 above. These transcript(s) encode for protein(s) which are variant(s) of protein Spondin 2 precursor. A description of each variant protein according to the present invention is now provided.

Variant protein Z39737_P9 (SEQ ID NO:307) according to the present invention has an amino acid sequence as given at the end of the application; it is encoded by transcript(s) Z39737_T20 (SEQ ID NO:306). An alignment is given to the known protein (Spondin 2 precursor) in the alignment table on the attached CD-ROM. A brief description of the relationship of the variant protein according to the present invention to each such aligned protein is as follows:

1. Comparison report between Z39737_P9 (SEQ ID NO:307) and SPO2_HUMAN_V1:

A. An isolated chimeric polypeptide as set forth in Z39737_P9 (SEQ ID NO:307), comprising a first amino acid sequence being at least 90% homologous to MENPSPAAAL-GKALCALLLATLGAAGQPLGGESICSA-RAPAKYSITFTGKWSQTAFPKQYPLFRPPAQWSSLLG AAHSSDYSMWRKNQYVSNGLRDFAER-GEAWALMKEIEAAGEALQSVHAVFSAPAVPSGTGQT corresponding to amino acids 1-136 of SPO2_HUMAN_V1, which also corresponds to amino acids 1-136 of Z39737_P9 (SEQ ID NO:307), and a second amino acid sequence being at least 70%, optionally at least 80%, preferably at least 85%, more preferably at least 90% and most preferably at least 95% homologous to a polypeptide having the sequence FLQQGCPPSPGVPTGFPGASYSATMWEF-HHHRDLSGSSGSYVETRNSSP (SEQ ID NO: 494) corresponding to amino acids 137-185 of Z39737_P9 (SEQ ID NO:307), wherein said first amino acid sequence and second amino acid sequence are contiguous and in a sequential order.

B. An isolated polypeptide encoding for an edge portion of Z39737_P9 (SEQ ID NO:307), comprising an amino acid sequence being at least 70%, optionally at least about 80%, preferably at least about 85%, more preferably at least about 90% and most preferably at least about 95% homologous to the sequence FLQQGCPPSPGVPTGFPGASYSATMWEF-HHHRDLSGSSGSYVETRNSSP (SEQ ID NO: 494) of Z39737_P9 (SEQ ID NO:307).

It should be noted that the known protein sequence (SPO2_HUMAN (SEQ ID NO: 442) has one or more changes than the sequence given at the end of the application and named as being the amino acid sequence for SPO2_HUMAN_V1. These changes were previously known to occur and are listed in the table below.

TABLE 277

Changes to SPO2_HUMAN_V1

| SNP position on amino acid sequence | Type of change |
|---|---|
| 122 | variant |

The localization of the variant protein was determined according to results from a number of different software programs and analyses, including analyses from SignalP and other specialized programs. The variant protein is secreted.

Variant protein Z39737_P9 (SEQ ID NO:307) also has the following non-silent SNPs (Single Nucleotide Polymorphisms) as listed in Table 278, (given according to their position(s) on the amino acid sequence, with the alternative amino acid(s) listed; the presence of known SNPs in variant protein Z39737_P9 (SEQ ID NO:307) sequence provides support for the deduced sequence of this variant protein according to the present invention).

TABLE 278

Amino acid mutations

| SNP position(s) on amino acid sequence | Alternative amino acid(s) |
|---|---|
| 25 | A -> |
| 38 | R -> G |
| 40 | P -> L |
| 99 | E -> |
| 122 | A -> E |
| 136 | T -> |
| 156 | S -> P |

Variant protein Z39737_P9 (SEQ ID NO:307) is encoded by the following transcript(s): Z39737_T20 (SEQ ID NO:306), for which the coding portion starts at position 321 and ends at position 875. The transcript also has the following SNPs as listed in Table 279 (given according to their position on the nucleotide sequence, with the alternative nucleic acid listed; the presence of known SNPs in variant protein Z39737_P9 (SEQ ID NO:307) sequence provides support for the deduced sequence of this variant protein according to the present invention).

TABLE 279

Nucleic acid SNPs

| Polymorphism | SNP position(s) on nucleotide sequence |
|---|---|
| A -> | 28, 111, 726, 1339 |
| G -> | 51, 617, 1379, 1426, 1602 |
| C -> | 394, 1275 |
| G -> A | 416, 1035, 1325 |
| A -> G | 432, 1222 |
| C -> T | 439, 1110, 1175, 1370, 1647 |
| C -> A | 685, 1792 |
| T -> C | 786, 1124, 1138 |
| G -> C | 1379 |
| A -> C | 1791 |

Variant protein Z39737_P25 (SEQ ID NO:308) according to the present invention has an amino acid sequence as given at the end of the application; it is encoded by transcript(s) Z39737_T5 (SEQ ID NO:305).

The localization of the variant protein was determined according to results from a number of different software programs and analyses, including analyses from SignalP and other specialized programs. The variant protein is secreted.

Variant protein Z39737_P25 (SEQ ID NO:308) also has the following non-silent SNPs (Single Nucleotide Polymorphisms) as listed in Table 280, (given according to their position(s) on the amino acid sequence, with the alternative amino acid(s) listed; the presence of known SNPs in variant protein Z39737_P25 (SEQ ID NO:308) sequence provides support for the deduced sequence of this variant protein according to the present invention).

TABLE 280

Amino acid mutations

| SNP position(s) on amino acid sequence | Alternative amino acid(s) |
|---|---|
| 25 | A -> |
| 38 | R -> G |
| 40 | P -> L |

Variant protein Z39737_P25 (SEQ ID NO:308) is encoded by the following transcript(s): Z39737 (SEQ ID NO:305), for which the coding portion starts at position 321 and ends at position 641. The transcript also has the following SNPs as listed in Table 281 (given according to their position on the nucleotide sequence, with the alternative nucleic acid listed; the presence of known SNPs in variant protein Z39737_P25 (SEQ ID NO:308) sequence provides support for the deduced sequence of this variant protein according to the present invention).

TABLE 281

Nucleic acid SNPs

| Polymorphism | SNP position(s) on nucleotide sequence |
|---|---|
| A -> | 28, 111 |
| G -> | 51, 982, 1476, 1805, 1852, 2028 |
| C -> | 394, 1449, 1701 |
| G -> A | 416, 1378, 1751 |
| A -> G | 432, 1648 |
| C -> T | 439, 664, 1536, 1601, 1796, 2073 |
| G -> C | 593, 1409, 1805 |
| C -> A | 1050, 2218 |
| A -> | 1091, 1765 |
| T -> A | 1137 |
| -> T | 1231 |
| C -> G | 1235, 1449 |
| T -> C | 1550, 1564 |
| A -> C | 2217 |

Figure 50:
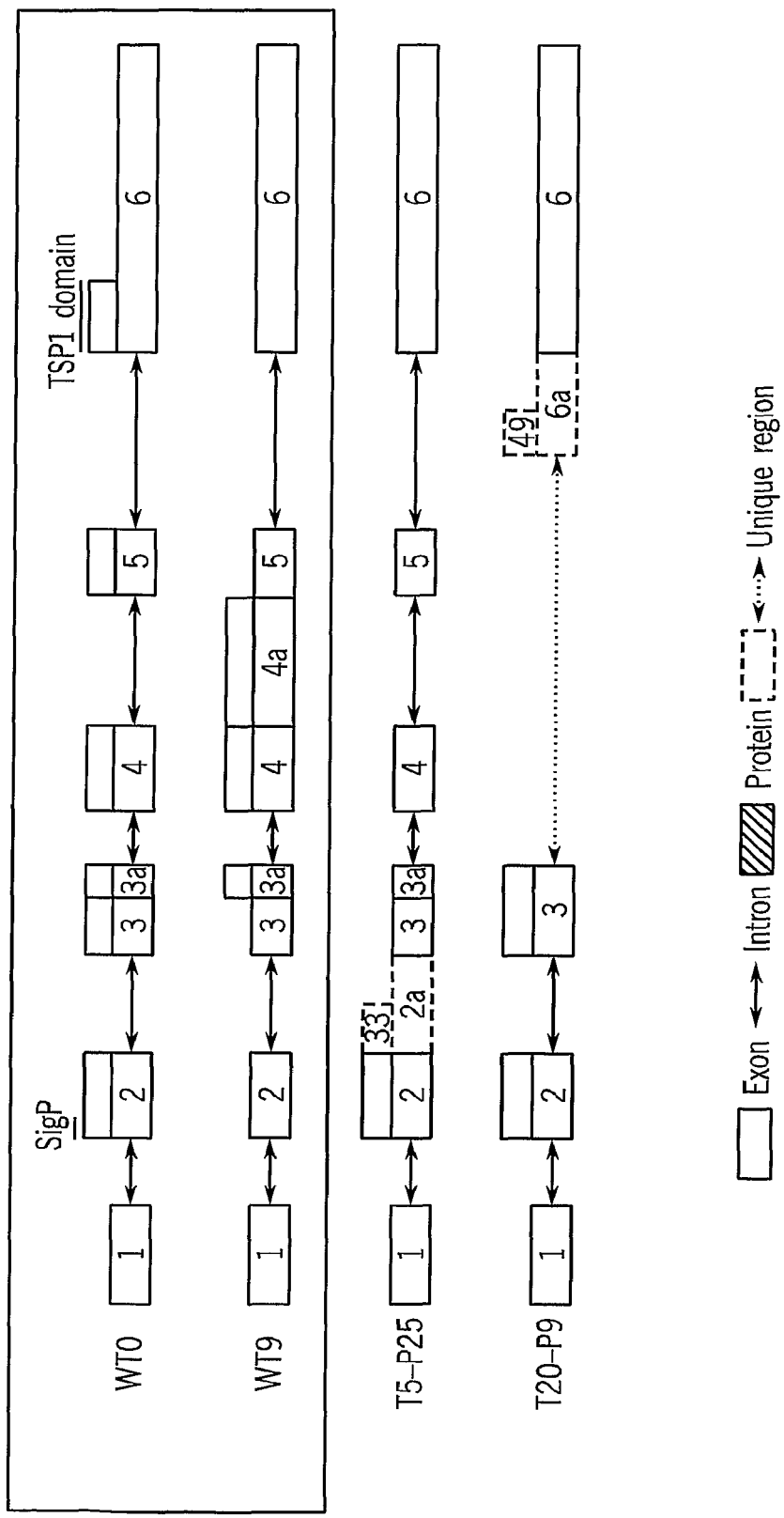
FIG. 50 shows mRNA and Protein Structure of Z39737 variants. Exons are represented by white boxes, while introns are represented by two headed arrows. Proteins are shown in boxes with upper right to lower left fill. The unique regions are represented by white boxes with dashed frame.

FIG. 50 shows mRNA and Protein Structure of Z39737 variants. Exons are represented by white boxes, while introns are represented by two headed arrows. Proteins are shown in boxes with upper right to lower left fill. The unique regions are represented by white boxes with dashed frame.

Description for Cluster Z25299

Cluster Z25299 features 5 transcript(s) and 9 segment(s) of interest, the names for which are given in Tables 282 and 283, respectively. The selected protein variants are given in table 284.

TABLE 282

Transcripts of interest
Transcript Name

Z25299_T1 (SEQ ID NO: 340)

Z25299_T2 (SEQ ID NO: 341)

Z25299_T5 (SEQ ID NO: 342)

Z25299_T6 (SEQ ID NO: 343)

Z25299_T9 (SEQ ID NO: 344)

TABLE 283

Segments of interest
Segment Name

Z25299_N8 (SEQ ID NO: 350)

Z25299_N13 (SEQ ID NO: 352)

Z25299_N16 (SEQ ID NO: 354)

Z25299_N17 (SEQ ID NO: 355)

Z25299_N18 (SEQ ID NO: 356)

Z25299_N20 (SEQ ID NO: 357)

Z25299_N21 (SEQ ID NO: 358)

Z25299_N12 (SEQ ID NO: 351)

Z25299_N15 (SEQ ID NO: 353)

TABLE 284

Proteins of interest

| Protein Name | Corresponding Transcript(s) |
|---|---|
| Z25299_P1 (SEQ ID NO: 345) | Z25299_T1 (SEQ ID NO: 340) |
| Z25299_P4 (SEQ ID NO: 346) | Z25299_T5 (SEQ ID NO: 342) |
| Z25299_P5 (SEQ ID NO: 347) | Z25299_T6 (SEQ ID NO: 343) |
| Z25299_P6 (SEQ ID NO: 348) | Z25299_T2 (SEQ ID NO: 341) |
| Z25299_P8 (SEQ ID NO: 349) | Z25299_T9 (SEQ ID NO: 344) |

These sequences are variants of the known protein Antileukoproteinase 1 precursor (SwissProt accession identifier ALK1_HUMAN (SEQ ID NO:443); known also according to the synonyms ALP; HUSI-1; Seminal proteinase inhibitor; Secretory leukocyte protease inhibitor; BLPI; Mucus proteinase inhibitor; MPI; WAP four-disulfide core domain protein 4; Protease inhibitor WAP4), referred to herein as the previously known protein.

Protein Antileukoproteinase 1 precursor is known or believed to have the following function(s): Acid-stable proteinase inhibitor with strong affinities for trypsin, chymotrypsin, elastase, and cathepsin G. May prevent elastase-mediated damage to oral and possibly other mucosal tissues. Protein Antileukoproteinase 1 precursor localization is believed to be Secreted.

The previously known protein also has the following indication(s) and/or potential therapeutic use(s): Unspecified. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Elastase inhibitor; Tryptase inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antiasthma; Recombinant, other.

The following GO Annotation(s) apply to the previously known protein. The following annotation(s) were found: endopeptidase inhibitor activity, which are annotation(s) related to Molecular Function.

The GO assignment relies on information from one or more of the SwissProt/TremBl Protein knowledgebase or Locuslink.

Cluster Z25299 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 51 refer to weighted expression of ESTs in each category, as "parts per million" (ratio of the expression of ESTs for a particular cluster to the expression of all ESTs in that category, according to parts per million).

Figure 51:
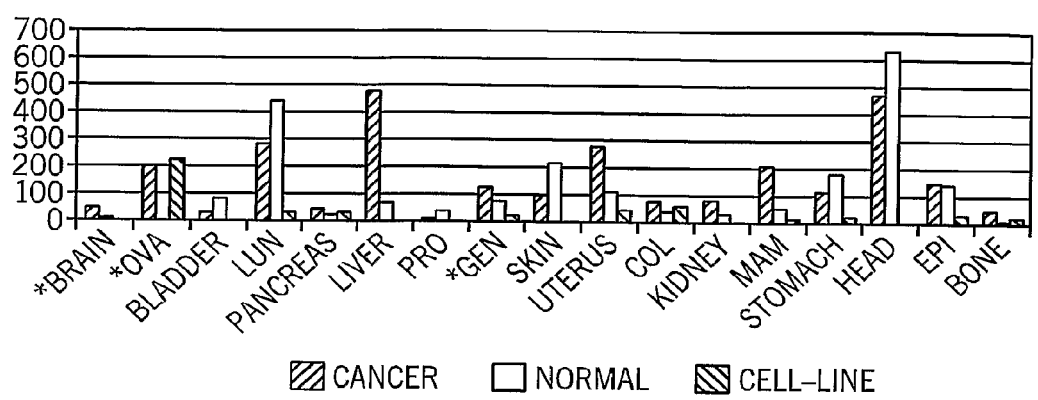
FIG. 51 shows a graph of cancer and cell-line vs. normal tissue expression for Z25299.

Overall, the following results were obtained as shown with regard to the histograms in FIG. 51 and Table 285. This cluster is overexpressed (at least at a minimum level) in the following pathological conditions: brain malignant tumors, ovarian carcinoma and a mixture of malignant tumors from different tissues.

TABLE 285

Normal tissue distribution

| Name of Tissue | Number |
|---|---|
| brain | 4 |
| ovary | 0 |
| bladder | 82 |
| lung | 440 |
| pancreas | 20 |
| liver | 68 |
| prostate | 35 |
| general | 71 |
| skin | 214 |
| uterus | 112 |
| colon | 39 |
| kidney | 28 |
| breast | 51 |
| stomach | 180 |
| head and neck | 636 |
| epithelial | 140 |
| bone | 6 |

TABLE 286

P values and ratios for expression in cancerous tissue

| Name of Tissue | P1 | P2 | SP1 | R3 | SP2 | R4 |
|---|---|---|---|---|---|---|
| brain | 2.2e-01 | 3.8e-01 | 8.0e-03 | 3.6 | 6.6e-02 | 1.8 |
| ovary | 3.7e-02 | 3.0e-02 | 1.0e-02 | 5.6 | 6.5e-03 | 5.2 |
| bladder | 8.2e-01 | 8.5e-01 | 9.2e-01 | 0.6 | 9.7e-01 | 0.5 |
| lung | 6.9e-01 | 8.5e-01 | 9.6e-01 | 0.5 | 1.0e+00 | 0.3 |
| pancreas | 3.4e-01 | 3.2e-01 | 3.6e-01 | 1.7 | 3.9e-01 | 1.5 |
| liver | 4.1e-01 | 9.2e-01 | 4.2e-02 | 3.2 | 6.5e-01 | 0.8 |
| prostate | 9.1e-01 | 9.2e-01 | 8.9e-01 | 0.5 | 9.4e-01 | 0.5 |
| general | 2.5e-03 | 1.8e-01 | 1.4e-06 | 1.6 | 4.8e-01 | 0.9 |
| skin | 5.1e-01 | 7.6e-01 | 9.3e-01 | 0.4 | 1.0e+00 | 0.1 |
| uterus | 1.3e-01 | 9.8e-02 | 4.0e-02 | 1.6 | 3.3e-01 | 1.1 |
| colon | 3.8e-01 | 3.2e-01 | 4.1e-01 | 1.5 | 4.2e-01 | 1.4 |
| kidney | 7.4e-01 | 8.4e-01 | 2.0e-01 | 2.0 | 4.1e-01 | 1.4 |
| breast | 5.0e-01 | 6.1e-01 | 9.6e-02 | 1.6 | 3.4e-01 | 1.1 |
| stomach | 1.4e-01 | 6.4e-01 | 8.6e-01 | 0.7 | 9.9e-01 | 0.4 |
| head and neck | 3.0e-01 | 5.2e-01 | 8.0e-01 | 0.6 | 1.0e+00 | 0.3 |
| epithelial | 1.1e-01 | 6.1e-01 | 3.4e-01 | 1.0 | 1.0e+00 | 0.6 |
| bone | 5.5e-01 | 7.3e-01 | 4.0e-01 | 2.1 | 4.9e-01 | 1.6 |

As noted above, cluster Z25299 features 5 transcript(s), which were listed in Table 282 above. These transcript(s) encode for protein(s) which are variant(s) of protein Antileukoproteinase 1 precursor. A description of each variant protein according to the present invention is now provided.

Variant protein Z25299_P1 (SEQ ID NO:345) according to the present invention has an amino acid sequence as given at the end of the application; it is encoded by transcript(s) Z25299_T1 (SEQ ID NO:340). An alignment is given to the known protein (Antileukoproteinase 1 precursor) at in the alignment table on the attached CD-ROM. A brief description of the relationship of the variant protein according to the present invention to each such aligned protein is as follows:

1. Comparison report between Z25299_P1 (SEQ ID NO:345) and ALK1_HUMAN (SEQ ID NO:443):

A. An isolated chimeric polypeptide as set forth in Z25299_P1 (SEQ ID NO:345), comprising a first amino acid sequence being at least 90% homologous to MKSSGLFP-FLVLLALGTLAPWAVEGSGKSFKAGVCP-PKKSAQCLRYKKPECQSDWQCPGKKRC-CPDTCGIKCL DPVDTPNPTRRKPGKCPVTYGQCLMLNP-PNFCEMDGQCKRDLKCCMGMCGKSCVSPVK corresponding to amino acids 1-131 of ALK1_HUMAN (SEQ ID NO:443), which also corresponds to amino acids 1-131 of Z25299_P1 (SEQ ID NO:345), and a second amino acid sequence being at least 70%, optionally at least 80%, preferably at least 85%, more preferably at least 90% and most preferably at least 95% homologous to a polypeptide having the sequence GKQGMRAH (SEQ ID NO: 495) corresponding to amino acids 132-139 of Z25299_P1 (SEQ ID NO:345), wherein said first amino acid sequence and second amino acid sequence are contiguous and in a sequential order.

B. An isolated polypeptide encoding for an edge portion of Z25299_P1 (SEQ ID NO:345), comprising an amino acid sequence being at least 70%, optionally at least about 80%, preferably at least about 85%, more preferably at least about 90% and most preferably at least about 95% homologous to the sequence GKQGMRAH (SEQ ID NO: 495) of Z25299_P1 (SEQ ID NO:345).

The localization of the variant protein was determined according to results from a number of different software programs and analyses, including analyses from SignalP and other specialized programs. The variant protein is secreted.

Variant protein Z25299_P1 (SEQ ID NO:345) also has the following non-silent SNPs (Single Nucleotide Polymorphisms) as listed in Table 287, (given according to their position(s) on the amino acid sequence, with the alternative amino acid(s) listed; the presence of known SNPs in variant protein Z25299_P1 (SEQ ID NO:345) sequence provides support for the deduced sequence of this variant protein according to the present invention).

TABLE 287

Amino acid mutations

| SNP position(s) on amino acid sequence | Alternative amino acid(s) |
|---|---|
| 15 | L -> |
| 43 | C -> R |
| 48 | K -> N |
| 83 | R -> K |
| 136 | M -> T |

The variant protein has the following domains, as determined by using InterPro. The domains are described in Table 288:

TABLE 288

| InterPro domain(s) | | |
|---|---|---|
| Doman description | Analysis type | Position(s) on protein |
| Whey acidic protein, core region | FPrintScan | 28-37, 50-57, 57-66, 121-129 |
| Whey acidic protein, core region | HMMPfam | 31-75, 85-129 |
| Whey acidic protein, core region | HMMSmart | 31-76, 85-130 |
| Whey acidic protein, core region | ScanRegExp | 51-64, 105-118 |

Variant protein Z25299_P1 (SEQ ID NO:345) is encoded by the following transcript(s): Z25299_T1 (SEQ ID NO:340), for which the coding portion starts at position 124 and ends at position 540. The transcript also has the following SNPs as listed in Table 289 (given according to their position on the nucleotide sequence, with the alternative nucleic acid listed; the presence of known SNPs in variant protein Z25299_P1 (SEQ ID NO:345) sequence provides support for the deduced sequence of this variant protein according to the present invention).

TABLE 289

| Nucleic acid SNPs | |
|---|---|
| Polymorphism | SNP position(s) on nucleotide sequence |
| C -> T | 147, 166, 339, 435, 989, 1127 |
| C -> | 166 |
| T -> C | 250, 530, 851 |
| A -> G | 267 |
| A -> C | 267, 1162, 1180, 1183, 1216 |
| G -> A | 371, 1262 |

Variant protein Z25299_P4 (SEQ ID NO:346) according to the present invention has an amino acid sequence as given at the end of the application; it is encoded by transcript(s) Z25299_T5 (SEQ ID NO:342). An alignment is given to the known protein (Antileukoproteinase 1 precursor) in the alignment table on the attached CD-ROM. A brief description of the relationship of the variant protein according to the present invention to each such aligned protein is as follows:

1. Comparison report between Z25299_P4 (SEQ ID NO:346) and ALK1_HUMAN (SEQ ID NO:443):

A. An isolated chimeric polypeptide as set forth in Z25299_P4 (SEQ ID NO:346), comprising a first amino acid sequence being at least 90% homologous to MKSSGLFP-FLVLLALGTLAPWAVEGSGKSFKAGVCP-PKKSAQCLRYKKPECQSDWQCPGKKRC-CPDTCGIKCL DPVDTPNPTRRKPGKCPVTYGQCLMLNP-PNFCEMDGQCKRDLKCCMGMCGKSCVSPVK corresponding to amino acids 1-131 of ALK1_HUMAN (SEQ ID NO:443), which also corresponds to amino acids 1-131 of Z25299_P4 (SEQ ID NO:346), and a second amino acid sequence being at least 70%, optionally at least 80%, preferably at least 85%, more preferably at least 90% and most preferably at least 95% homologous to a polypeptide having the sequence GCFSPSISPSHFFTMSSISTFSAVLRT-SASSLSACVLPATHQMRSGEEFSTFGFMLVLK (SEQ ID NO: 496) corresponding to amino acids 132-190 of Z25299_P4 (SEQ ID NO:346), wherein said first amino acid sequence and second amino acid sequence are contiguous and in a sequential order.

B. An isolated polypeptide encoding for an edge portion of Z25299_P4 (SEQ ID NO:346), comprising an amino acid sequence being at least 70%, optionally at least about 80%, preferably at least about 85%, more preferably at least about 90% and most preferably at least about 95% homologous to the sequence GCFSPSISPSHFFTMSSISTFSAVLRT-SASSLSACVLPATHQMRSGEEFSTFGFMLVLK (SEQ ID NO: 496) of Z25299_P4 (SEQ ID NO:346).

The localization of the variant protein was determined according to results from a number of different software programs and analyses, including analyses from SignalP and other specialized programs. The variant protein is secreted.

Variant protein Z25299_P4 (SEQ ID NO:346) also has the following non-silent SNPs (Single Nucleotide Polymorphisms) as listed in Table 290, (given according to their position(s) on the amino acid sequence, with the alternative amino acid(s) listed; the presence of known SNPs in variant protein Z25299_P4 (SEQ ID NO:346) sequence provides support for the deduced sequence of this variant protein according to the present invention).

TABLE 290

| Amino acid mutations | |
|---|---|
| SNP position(s) on amino acid sequence | Alternative amino acid(s) |
| 15 | L -> |
| 43 | C -> R |
| 48 | K -> N |
| 83 | R -> K |

The variant protein has the following domains, as determined by using InterPro. The domains are described in Table 291:

TABLE 291

| InterPro domain(s) Domain description | Analysis type | Position(s) on protein |
|---|---|---|
| Whey acidic protein, core region | FPrintScan | 28-37, 50-57, 57-66, 121-129 |
| Whey acidic protein, core region | HMMPfam | 31-75, 85-129 |
| Whey acidic protein, core region | HMMSmart | 31-76, 85-130 |
| Whey acidic protein, core region | ScanRegExp | 51-64, 105-118 |

Variant protein Z25299_P4 (SEQ ID NO:346) is encoded by the following transcript(s): Z25299 (SEQ ID NO:342), for which the coding portion starts at position 124 and ends at position 693. The transcript also has the following SNPs as listed in Table 292 (given according to their position on the nucleotide sequence, with the alternative nucleic acid listed; the presence of known SNPs in variant protein Z25299_P4 (SEQ ID NO:346) sequence provides support for the deduced sequence of this variant protein according to the present invention).

TABLE 292

| Nucleic acid SNPs | |
|---|---|
| Polymorphism | SNP position(s) on nucleotide sequence |
| C -> T | 147, 166, 339, 435 |
| C -> | 166 |
| T -> C | 250 |
| A -> G | 267 |
| A -> C | 267 |
| G -> A | 371 |

Variant protein Z25299_P5 (SEQ ID NO:347) according to the present invention has an amino acid sequence as given at the end of the application; it is encoded by transcript(s) Z25299_P4 (SEQ ID NO:343). An alignment is given to the known protein (Antileukoproteinase 1 precursor) in the alignment table on the attached CD-ROM. A brief description of the relationship of the variant protein according to the present invention to each such aligned protein is as follows:

1. Comparison report between Z25299_P5 (SEQ ID NO:347) and ALK1_HUMAN (SEQ ID NO:443):

A. An isolated chimeric polypeptide as set forth in Z25299_P5 (SEQ ID NO:347), comprising a first amino acid sequence being at least 90% homologous to MKSSGLFPFLVLLALGTLAPWAVEGSGKSFKAGVCPPKKSAQCLRYKKPECQSDWQCPGKKRCCPDTCGIKCL DPVDTPNPTRRKPGKCPVTYGQCLMLNPPNFCEMDGQCKRDLKCCMGMCGKSCVSPVK corresponding to amino acids 1-131 of ALK1_HUMAN (SEQ ID NO:443), which also corresponds to amino acids 1-131 of Z25299_P5 (SEQ ID NO:347), and a second amino acid sequence being at least 70%, optionally at least 80%, preferably at least 85%, more preferably at least 90% and most preferably at least 95% homologous to a polypeptide having the sequence GEKRHHKQLRDQEVDPLEMRRHSAG (SEQ ID NO: 497) corresponding to amino acids 132-156 of Z25299_P5 (SEQ ID NO:347), wherein said first amino acid sequence and second amino acid sequence are contiguous and in a sequential order.

B. An isolated polypeptide encoding for an edge portion of Z25299_P5 (SEQ ID NO:347), comprising an amino acid sequence being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 497) of Z25299_P5 (SEQ ID NO:347).

The localization of the variant protein was determined according to results from a number of different software programs and analyses, including analyses from SignalP and other specialized programs. The variant protein is secreted.

Variant protein Z25299_P5 (SEQ ID NO:347) also has the following non-silent SNPs (Single Nucleotide Polymorphisms) as listed in Table 293, (given according to their position(s) on the amino acid sequence, with the alternative amino acid(s) listed; the presence of known SNPs in variant protein Z25299_P5 (SEQ ID NO:347) sequence provides support for the deduced sequence of this variant protein according to the present invention).

TABLE 293

Amino acid mutations

| SNP position(s) on amino acid sequence | Alternative amino acid(s) |
|---|---|
| 15 | L -> |
| 43 | C -> R |
| 48 | K -> N |
| 83 | R -> K |

The variant protein has the following domains, as determined by using InterPro. The domains are described in Table 294:

TABLE 294

InterPro domain(s)

| Doman description | Analysis type | Position(s) on protein |
|---|---|---|
| Whey acidic protein, core region | FPrintScan | 28-37, 50-57, 57-66, 121-129 |
| Whey acidic protein, core region | HMMPfam | 31-75, 85-129 |
| Whey acidic protein, core region | HMMSmart | 31-76, 85-130 |
| Whey acidic protein, core region | ScanRegExp | 51-64, 105-118 |

Variant protein Z25299_P5 (SEQ ID NO:347) is encoded by the following transcript(s): Z25299_T6 (SEQ ID NO:343), for which the coding portion starts at position 124 and ends at position 591. The transcript also has the following SNPs as listed in Table 295 (given according to their position on the nucleotide sequence, with the alternative nucleic acid listed; the presence of known SNPs in variant protein Z25299_P5 (SEQ ID NO:347) sequence provides support for the deduced sequence of this variant protein according to the present invention).

TABLE 295

Nucleic acid SNPs

| Polymorphism | SNP position(s) on nucleotide sequence |
|---|---|
| C -> T | 147, 166, 339, 435, |
| C -> | 166 |
| T -> C | 250 |
| A -> G | 267 |
| A -> C | 267 |
| G -> A | 371 |

Variant protein Z25299_P6 (SEQ ID NO:348) according to the present invention has an amino acid sequence as given at the end of the application; it is encoded by transcript(s) Z25299_T2 (SEQ ID NO:341). An alignment is given to the known protein (Antileukoproteinase 1 precursor) in the alignment table on the attached CD-ROM. A brief description of the relationship of the variant protein according to the present invention to each such aligned protein is as follows:

1. Comparison report between Z25299_P6 (SEQ ID NO:348) and ALK1_HUMAN (SEQ ID NO:443):

A. An isolated chimeric polypeptide as set forth in Z25299_P6 (SEQ ID NO:348), comprising a first amino acid sequence being at least 90% homologous to MKSSGLFPFLVLLALGTLAPWAVEGSGKSFKAGVCPPKKSAQCLRYKKPECQSDWQCPGKKRCCPDTCGIKCL DPVDTPNP corresponding to amino acids 1-81 of ALK1_HUMAN (SEQ ID NO:443), which also corresponds to amino acids 1-81 of Z25299_P6 (SEQ ID NO:348), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 498) corresponding to amino acids 82-89 of Z25299_P6 (SEQ ID NO:348), wherein said first amino acid sequence and second amino acid sequence are contiguous and in a sequential order.

B. An isolated polypeptide encoding for an edge portion of Z25299_P6 (SEQ ID NO:348), comprising an amino acid sequence being at least 70%, optionally at least about 80%, preferably at least about 85%, more preferably at least about 90% and most preferably at least about 95% homologous to the sequence RGSLGSAQ (SEQ ID NO: 498) of Z25299_P6 (SEQ ID NO:348).

The localization of the variant protein was determined according to results from a number of different software programs and analyses, including analyses from SignalP and other specialized programs. The variant protein is secreted.

Variant protein Z25299_P6 (SEQ ID NO:348) also has the following non-silent SNPs (Single Nucleotide Polymorphisms) as listed in Table 296, (given according to their position(s) on the amino acid sequence, with the alternative amino acid(s) listed; the presence of known SNPs in variant protein Z25299_P6 (SEQ ID NO:348) sequence provides support for the deduced sequence of this variant protein according to the present invention).

TABLE 296

Amino acid mutations

| SNP position(s) on amino acid sequence | Alternative amino acid(s) |
|---|---|
| 15 | L -> |
| 43 | C -> R |
| 48 | K -> N |

The variant protein has the following domains, as determined by using InterPro. The domains are described in Table 297:

TABLE 297

InterPro domain(s)

| Domain description | Analysis type | Position(s) on protein |
|---|---|---|
| Whey acidic protein, core region | FPrintScan | 28-37, 50-57, 57-66, 67-75 |
| Whey acidic protein, core region | HMMPfam | 31-75 |
| Whey acidic protein, core region | HMMSmart | 31-76 |
| Whey acidic protein, core region | ScanRegExp | 51-64 |

Variant protein Z25299_P6 (SEQ ID NO:348) is encoded by the following transcript(s): Z25299_T2 (SEQ ID NO:341), for which the coding portion starts at position 124 and ends at position 390. The transcript also has the following SNPs as listed in Table 298 (given according to their position on the nucleotide sequence, with the alternative nucleic acid listed; the presence of known SNPs in variant protein Z25299_P6 (SEQ ID NO:348) sequence provides support for the deduced sequence of this variant protein according to the present invention).

TABLE 298

Nucleic acid SNPs

| Polymorphism | SNP position(s) on nucleotide sequence |
|---|---|
| C -> T | 147, 166, 399, 431, 541 |
| C -> | 166 |
| T -> C | 250 |
| A -> G | 267 |
| A -> C | 267, 576, 594, 597, 630 |
| G -> A | 676 |

Variant protein Z25299_P8 (SEQ ID NO:349) according to the present invention has an amino acid sequence as given at the end of the application; it is encoded by transcript(s) Z25299_T9 (SEQ ID NO:344). An alignment is given to the known protein (Antileukoproteinase 1 precursor) in the alignment table on the attached CD-ROM. A brief description of the relationship of the variant protein according to the present invention to each such aligned protein is as follows:

1. Comparison report between Z25299_P8 (SEQ ID NO:349) and ALK1_HUMAN (SEQ ID NO:443):

A. An isolated chimeric polypeptide as set forth in Z25299_P8 (SEQ ID NO:349), comprising a amino acid sequence being at least 90% homologous to MKSSGLFP-FLVLLALGTLAPWAVEGSGKSFKAGVCP-PKKSAQCLRYKKPECQSDWQCPGKKRC-CPDTCGIKCL DPVDTPNPT corresponding to amino acids 1-82 of ALK1_HUMAN (SEQ ID NO:443), which also corresponds to amino acids 1-82 of Z25299_P8 (SEQ ID NO:349), wherein said and first amino acid sequence are contiguous and in a sequential order.

B. An isolated chimeric polypeptide encoding for an edge portion of Z25299_P8 (SEQ ID NO:349), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise T, having a structure as follows: a sequence starting from any of amino acid numbers 82−x to 82; and ending at any of amino acid numbers 82+((n−2)−x), in which x varies from 0 to n−2.

The localization of the variant protein was determined according to results from a number of different software programs and analyses, including analyses from SignalP and other specialized programs. The variant protein is secreted.

Variant protein Z25299_P8 (SEQ ID NO:349) also has the following non-silent SNPs (Single Nucleotide Polymorphisms) as listed in Table 299, (given according to their position(s) on the amino acid sequence, with the alternative amino acid(s) listed; the presence of known SNPs in variant protein Z25299_P8 (SEQ ID NO:349) sequence provides support for the deduced sequence of this variant protein according to the present invention).

TABLE 299

Amino acid mutations

| SNP position(s) on amino acid sequence | Alternative amino acid(s) |
|---|---|
| 15 | L -> |
| 43 | C -> R |
| 48 | K -> N |

The variant protein has the following domains, as determined by using InterPro. The domains are described in Table 300:

TABLE 300

InterPro domain(s)

| Domain description | Analysis type | Position(s) on protein |
|---|---|---|
| Whey acidic protein, core region | FPrintScan | 28-37, 50-57, 57-66, 67-75 |
| Whey acidic protein, core region | HMMPfam | 31-75 |
| Whey acidic protein, core region | HMMSmart | 31-76 |
| Whey acidic protein, core region | ScanRegExp | 51-64 |

Variant protein Z25299_P8 (SEQ ID NO:349) is encoded by the following transcript(s): Z25299 (SEQ ID NO:344), for which the coding portion starts at position 124 and ends at position 369. The transcript also has the following SNPs as listed in Table 301 (given according to their position on the nucleotide sequence, with the alternative nucleic acid listed; the presence of known SNPs in variant protein Z25299_P8

(SEQ ID NO:349) sequence provides support for the deduced sequence of this variant protein according to the present invention).

TABLE 301

Nucleic acid SNPs

| Polymorphism | SNP position(s) on nucleotide sequence |
|---|---|
| C -> T | 147, 166, 339, 395 |
| C -> | 166 |
| T -> C | 250 |
| A -> G | 267 |
| A -> C | 267, 430, 448, 451, 484 |
| G -> A | 530 |

As noted above, cluster Z25299 features 9 segment(s), which were listed in Table 283 above and for which the sequence(s) are given. These segment(s) are portions of nucleic acid sequence(s) which are described herein separately because they are of particular interest. A description of segments 13, 17, 18 and 20 according to the present invention is now provided.

Segment cluster Z25299_N13 (SEQ ID NO:352) according to the present invention is supported by 266 libraries. The number of libraries was determined as previously described. This segment can be found in the following transcript(s): Z25299_T1 (SEQ ID NO:340), Z25299_T2 (SEQ ID NO:341), Z25299_T5 (SEQ ID NO:342), Z25299_T6 (SEQ ID NO:343) and Z25299_T2 (SEQ ID NO:344). Table 302 below describes the starting and ending position of this segment on each transcript.

TABLE 302

Segment location on transcripts

| Transcript name | Segment starting position | Segment ending position |
|---|---|---|
| Z25299_T1 (SEQ ID NO: 340) | 246 | 367 |
| Z25299_T2 (SEQ ID NO: 341) | 246 | 367 |
| Z25299_T5 (SEQ ID NO: 342) | 246 | 367 |
| Z25299_T6 (SEQ ID NO: 343) | 246 | 367 |
| Z25299_T9 (SEQ ID NO: 344) | 246 | 367 |

Segment cluster Z25299_N17 (SEQ ID NO:355) according to the present invention is supported by 6 libraries. The number of libraries was determined as previously described. This segment can be found in the following transcript(s): Z25299_T1 (SEQ ID NO:340). Table 303 below describes the starting and ending position of this segment on each transcript.

TABLE 303

Segment location on transcripts

| Transcript name | Segment starting position | Segment ending position |
|---|---|---|
| Z25299_T1 (SEQ ID NO: 340) | 518 | 1099 |

Segment cluster Z25299_N18 (SEQ ID NO:356) according to the present invention is supported by 178 libraries. The number of libraries was determined as previously described. This segment can be found in the following transcript(s): Z25299_T1 (SEQ ID NO:340), Z25299_T2 (SEQ ID NO:341) and Z25299_T9 (SEQ ID NO:344). Table 304 below describes the starting and ending position of this segment on each transcript.

TABLE 304

Segment location on transcripts

| Transcript name | Segment starting position | Segment ending position |
|---|---|---|
| Z25299_T1 (SEQ ID NO: 340) | 1100 | 1282 |
| Z25299_T2 (SEQ ID NO: 341) | 514 | 696 |
| Z25299_T9 (SEQ ID NO: 344) | 368 | 550 |

Segment cluster Z25299_N20 (SEQ ID NO:357) according to the present invention is supported by 2 libraries. The number of libraries was determined as previously described. This segment can be found in the following transcript(s): Z25299_T6 (SEQ ID NO:343). Table 305 below describes the starting and ending position of this segment on each transcript.

TABLE 305

Segment location on transcripts

| Transcript name | Segment starting position | Segment ending position |
|---|---|---|
| Z25299_T6 (SEQ ID NO: 343) | 518 | 707 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 306.

TABLE 306

Oligonucleotides related to this segment

| Oligonucleotide name | Overexpressed in cancers | Chip reference |
|---|---|---|
| Z25299_0_3_0 (SEQ ID NO: 458) | ovarian carcinoma | OVA |

The sequence of the oligonucleotide Z25299030 (SEQ ID NO:458) is given.

>Z25299_0_3_0
(SEQ ID NO: 458)
AACTCTGGCACCTTGGGCTGTGGAAGGCTCTGGAAAGTCCTTCAAAGCTG

Segment cluster Z25299_N15 (SEQ ID NO:353) according to the present invention is supported by 233 libraries. The number of libraries was determined as previously described. This segment can be found in the following transcript(s): Z25299_T1 (SEQ ID NO:340), Z25299_T5 (SEQ ID NO:342) and Z25299_T6 (SEQ ID NO:343). Table 307 below describes the starting and ending position of this segment on each transcript.

TABLE 307

Segment location on transcripts

| Transcript name | Segment starting position | Segment ending position |
|---|---|---|
| Z25299_T1 (SEQ ID NO: 340) | 368 | 371 |
| Z25299_T5 (SEQ ID NO: 342) | 368 | 371 |
| Z25299_T6 (SEQ ID NO: 343) | 368 | 371 |

Figure 52:
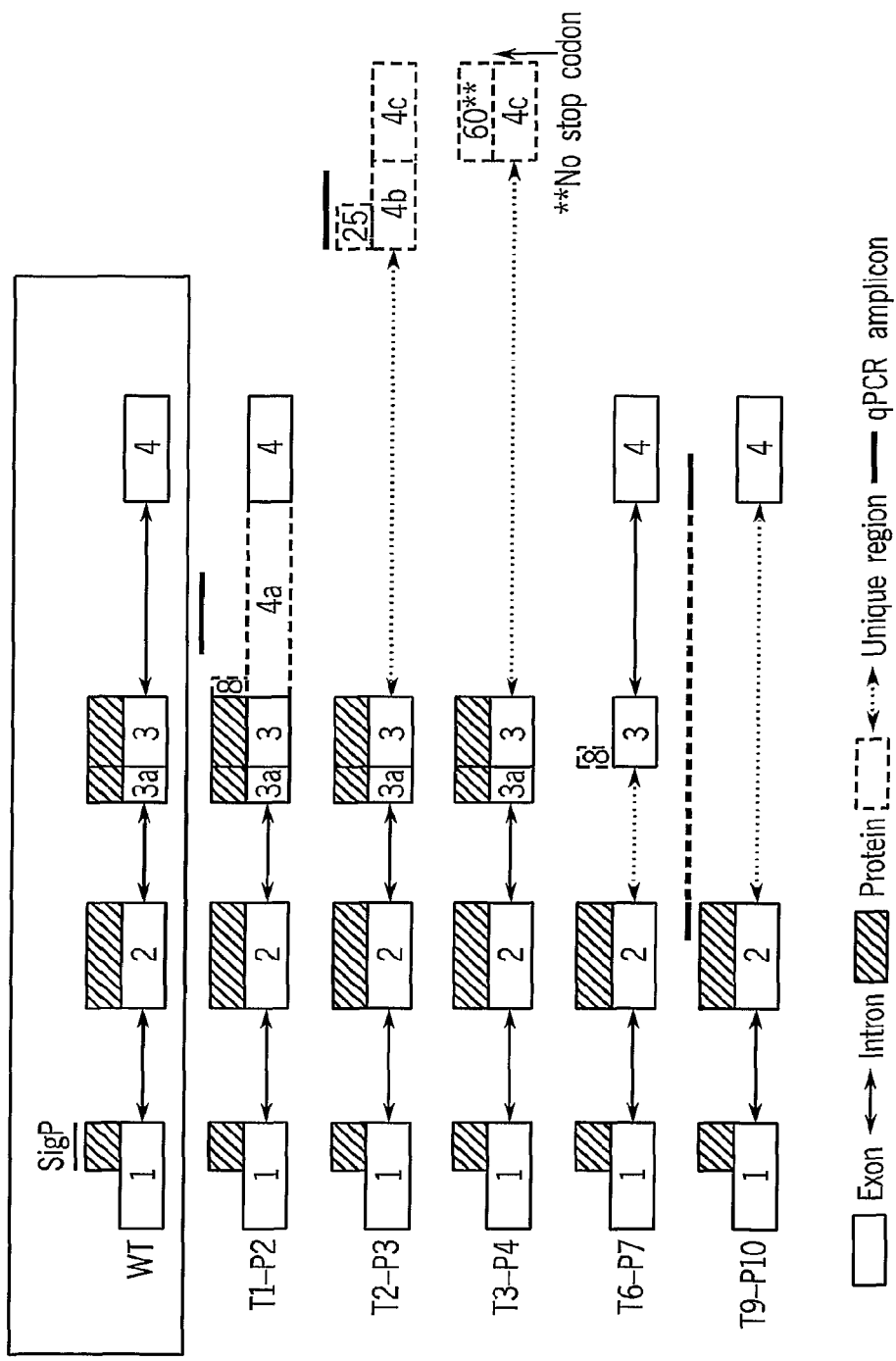
FIG. 52 shows mRNA and Protein Structure of Z25299 variants. Exons are represented by white boxes, while introns are represented by two headed arrows. Proteins are shown in boxes with upper right to lower left fill. The unique regions are represented by white boxes with dashed frame.

FIG. 52 shows mRNA and Protein Structure of Z25299 variants. Exons are represented by white boxes, while introns are represented by two headed arrows. Proteins are shown in boxes with upper right to lower left fill. The unique regions are represented by white boxes with dashed frame. A conversion table for the nodes listed in table 283 used for amplicons as described below is given in Table 308 below:

TABLE 308

| Amplicons names (as used below (POS)) | Corresponding amplicon names based on Table 272 above (DDS) |
|---|---|
| Seg 20 | seg 17 |
| Seg 23 | seg 20 |
| junc 13-14-21 | Junc 13-18 |

Expression of *Homo sapiens* Secretory Leukocyte Protease Inhibitor (Antileukoproteinase) Z25299 Transcripts which are Detectable by Amplicon as Depicted in Sequence Name Z25299_junc13-14-21 (SEQ ID NO:444) in Different Normal Tissues Expression of *Homo sapiens* secretory leukocyte protease inhibitor (antileukoproteinase) transcripts detectable by or according to seg23—Z25299_junc13-14-21 (SEQ ID NO:444) amplicon and primers Z25299_junc13-14-21F (SEQ ID NO: 445) and Z25299_junc13-14-21R (SEQ ID NO: 446) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the ovary samples (sample numbers 19 and 20, Table 5 above), to obtain a value of relative expression of each sample relative to median of the ovary samples.

Forward Primer (Z25299_junc13-14-21F
(SEQ ID NO: 445)):
ACCCCAAACCCAACTTGATTC

Reverse Primer (Z25299_junc13-14-21R
(SEQ ID NO: 446)):
TCAGTGGTGGAGCCAAGTCTC

Figure 53:
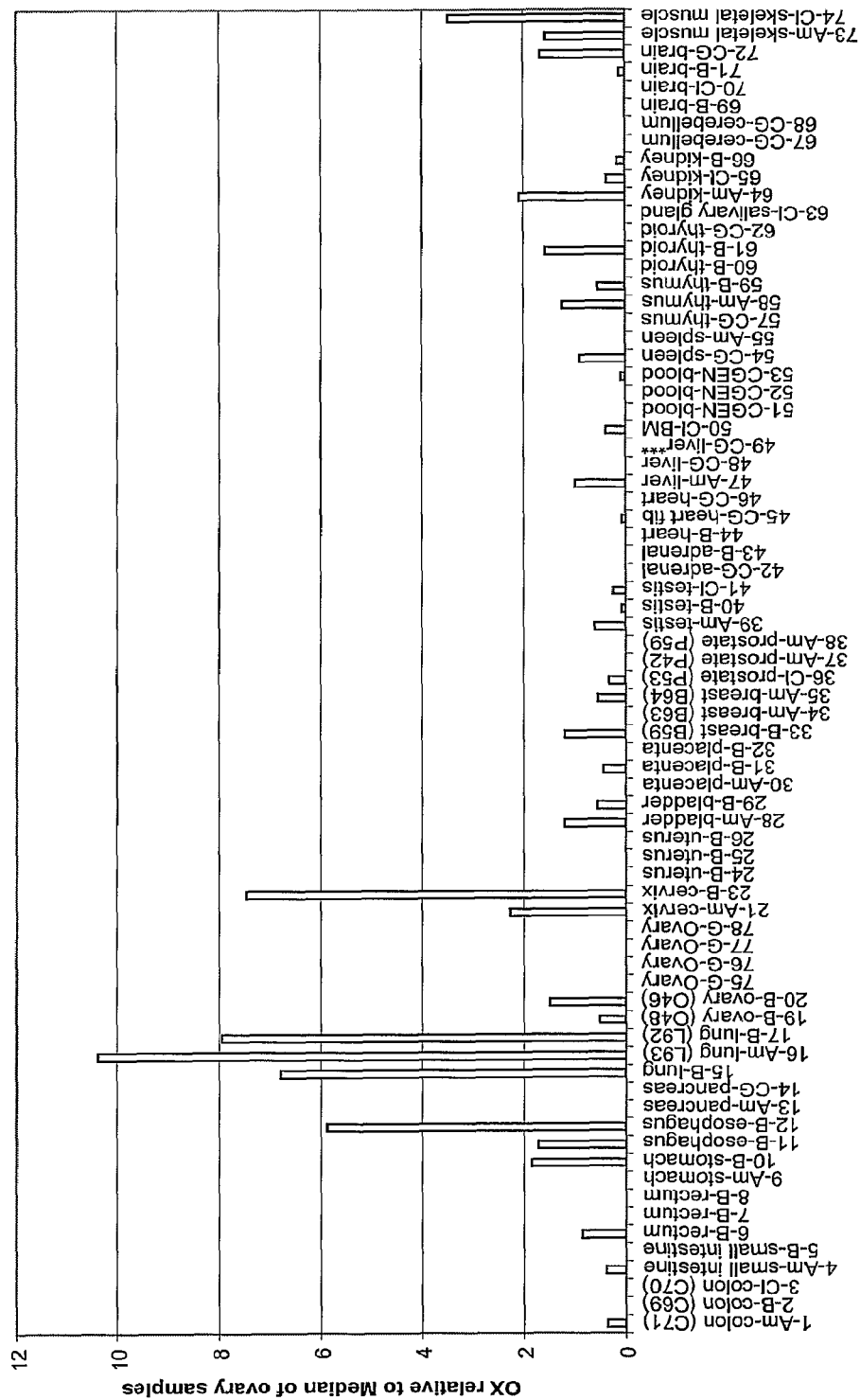
FIG. 53 is a histogram showing expression of the *Homo sapiens* secretory leukocyte protease inhibitor (antileukoproteinase) Z25299 transcripts which are detectable by amplicon as depicted in sequence name Z25299_junc13-14-21 (SEQ ID NO:444) in different normal tissues.

Amplicon (Z25299_s junc13-14-21 (SEQ ID NO: 444)):
ACCCCAAACCCAACTTGATTCCTGCCATATGGAGGAGGCTCTGGAGTC
CTGCTCTGTGTGGTCCAGGTCCTTTCCACCCTGAGACTTGGCTCCACC
ACTGA FIG. 53 is a histogram showing expression of the *Homo sapiens* secretory leukocyte protease inhibitor (antileukoproteinase) Z25299 transcripts which are detectable by amplicon as depicted in sequence name Z25299_junc13-14-21 (SEQ ID NO:444) in different normal tissues.

Expression of *Homo sapiens* Secretory Leukocyte Protease Inhibitor (Antileukoproteinase) Z25299 Transcripts which are Detectable by Amplicon as Depicted in Sequence Name Z25299_seg12-13WT (SEQ ID NO:447) in Different Normal Tissues Expression of *Homo sapiens* secretory leukocyte protease inhibitor (antileukoproteinase) transcripts detectable by or according to seg12-13WT—Z25299_seg12-13WT (SEQ ID NO:447) amplicon and primers Z25299_seg12-13WTF (SEQ ID NO:448) and Z25299_seg12-13WTR (SEQ ID NO:449) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the ovary samples (sample numbers 19 and 20, Table 5 above), to obtain a value of relative expression of each sample relative to median of the ovary samples.

Forward Primer (Z25299_seg12-13WTF
(SEQ ID NO: 448)):
AAGAAATCTGCCCAGTGCCT

Reverse Primer (Z25299_seg12-13WTR
(SEQ ID NO: 449)):
TTGATGCCACAAGTGTCAGGA

Figure 54:
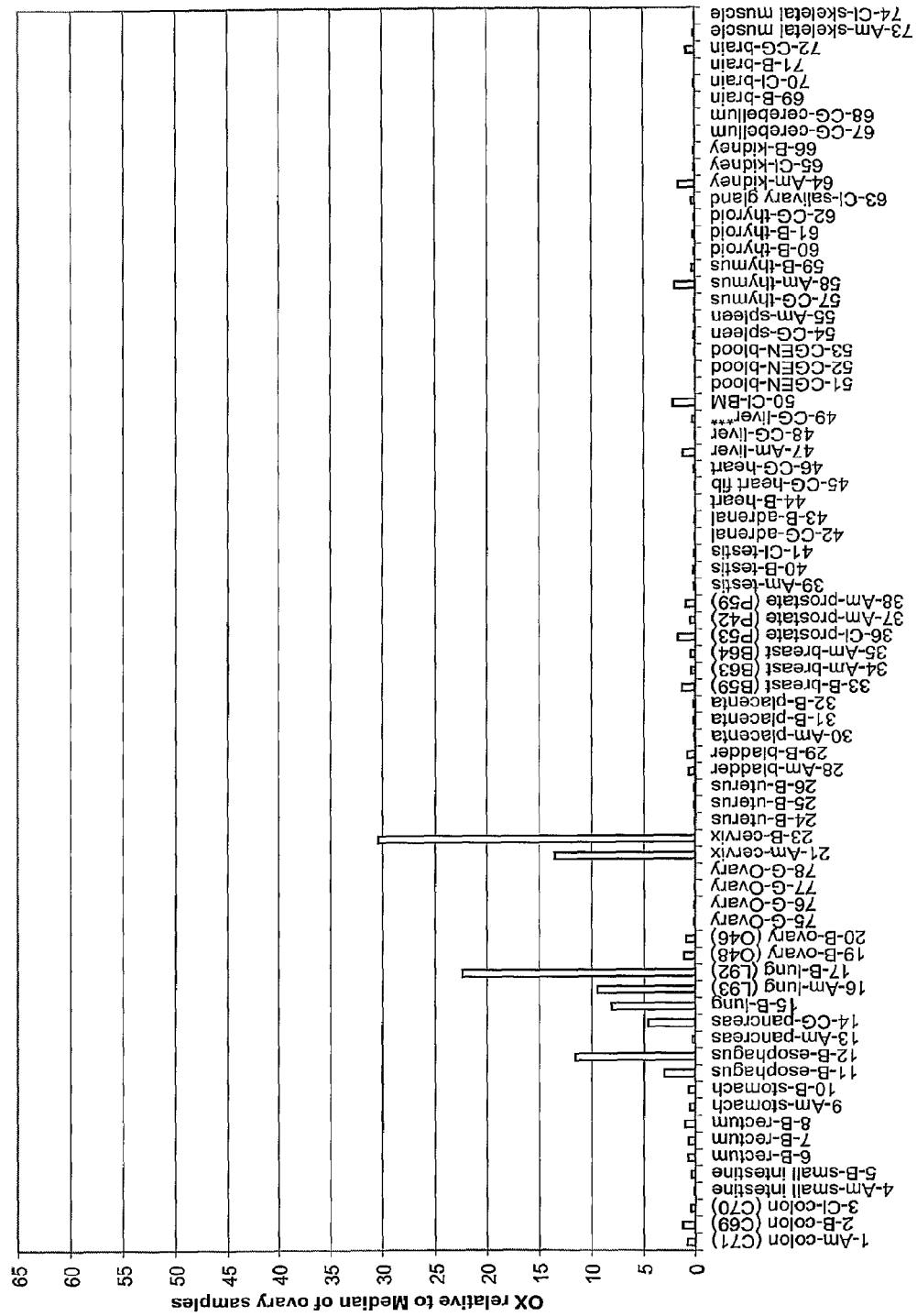
FIG. 54 is a histogram showing expression of the *Homo sapiens* secretory leukocyte protease inhibitor (antileukoproteinase) Z25299 transcripts which are detectable by amplicon as depicted in sequence name Z25299_seg12-13WT (SEQ ID NO: 447) in different normal tissues.

Amplicon (Z25299_seg12-13WT (SEQ ID NO: 447)):
AAGAAATCTGCCCAGTGCCTTAGATACAAGAAACCTGAGTGCCAGAGT
GACTGGCAGTGTCCAGGGAAGAAGAGATGTTGTCCTGACACTTGTGGC
ATCAA FIG. 54 is a histogram showing expression of the *Homo sapiens* secretory leukocyte protease inhibitor (antileukoproteinase) Z25299 transcripts which are detectable by amplicon as depicted in sequence name Z25299_seg12-13WT (SEQ ID NO: 447) in different normal tissues.

Expression of *Homo sapiens* Secretory Leukocyte Protease Inhibitor (Antileukoproteinase) Z25299 Transcripts which are Detectable by Amplicon as Depicted in Sequence Name Z25299_seg12-13WT (SEQ ID NO:447) in Normal and Cancerous Lung Tissues Expression of *Homo sapiens* secretory leukocyte protease inhibitor (antileukoproteinase) transcripts detectable by or according to seg12-13WT—Z25299_seg12-13WT (SEQ ID NO:447) amplicon and primers Z25299_seg12-13WTF (SEQ ID NO:448) and Z25299_seg12-13WTR (SEQ ID NO:449) was measured by real time PCR. In parallel the expression of four housekeeping genes—SDHA (GenBank Accession No. NM_004168 (SEQ ID NO:364); amplicon—SDHA-amplicon (SEQ ID NO:365)), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—

PBGD-amplicon (SEQ ID NO:382)) and GAPDH (GenBank Accession No. BC026907 (SEQ ID NO:451); GAPDH (SEQ ID NO:450) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold differential expression for each sample relative to median of the normal PM samples—these values are plotted in FIG. 55. Then the reciprocal of this ratio was calculated, to obtain a value of fold down-regulation for each sample relative to median of the normal PM samples—these values are plotted in FIG. 56.

Figure 55:
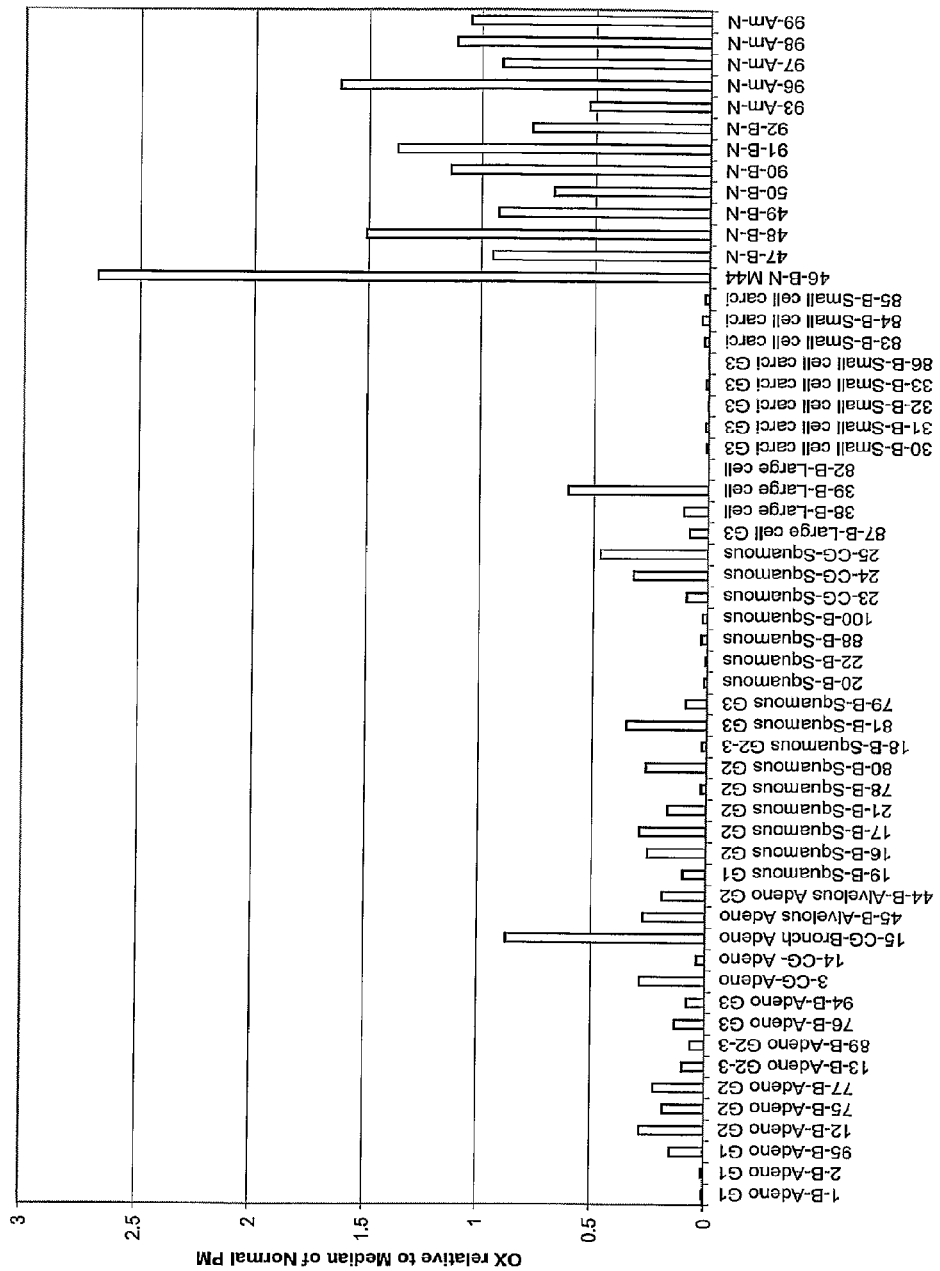
FIGS. 55-56 are histograms showing down regulation of the *Homo sapiens* secretory leukocyte protease inhibitor (antileukoproteinase) Z25299 transcripts which are detectable by amplicon as depicted in sequence name Z25299_seg12-13WT (SEQ ID NO: 447) in cancerous lung samples relative to the normal samples.
Figure 56:
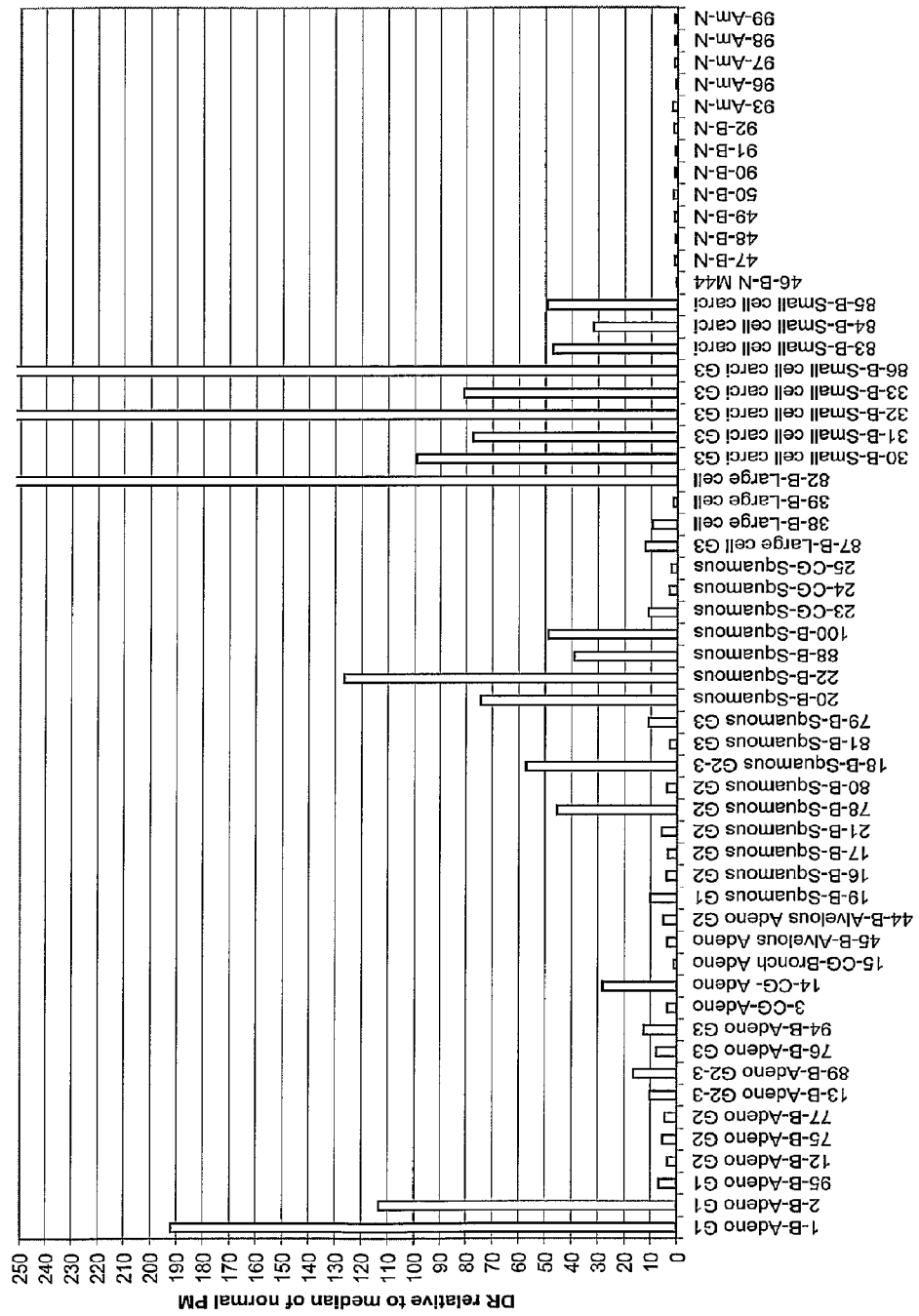

FIGS. 55 and 56 are histograms showing down regulation of the above-indicated *Homo sapiens* secretory leukocyte protease inhibitor (antileukoproteinase) transcripts in cancerous lung samples relative to the normal samples.

As is evident from FIGS. 55 and 56, the expression of *Homo sapiens* secretory leukocyte protease inhibitor (antileukoproteinase) transcripts detectable by the above amplicon in cancer samples, mainly in the small cell carcinoma was lower than in the non-cancerous samples (sample numbers 47, 48, 49, 50, 90, 91, 92, 93, 96, 97, 98 and 99, Table 3 above). Notably down regulation of at least 5 fold was found in 10 out of 15 adenocarcinoma samples, 10 out of 16 squamous cell carcinoma samples, 3 out of 4 large cell carcinoma samples and in 8 out of 8 small cells carcinoma samples.

Primer pairs are also optionally and preferably encompassed within the present invention; for example, for the above experiment, the following primer pair was used as a non-limiting illustrative example only of a suitable primer pair: Z25299_seg12-13WTF (SEQ ID NO:448) forward primer; and Z25299_seg12-13WTR (SEQ ID NO:449) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg12-13WT (SEQ ID NO:447).

```
Forward Primer (Z25299_seg12-13WTF
(SEQ ID NO: 448)):
AAGAAATCTGCCCAGTGCCT

Reverse Primer (Z25299_seg12-13WTR
(SEQ ID NO: 449)):
TTGATGCCACAAGTGTCAGGA

Amplicon (Z25299_seg12-13WT (SEQ ID NO: 447)):
AAGAAATCTGCCCAGTGCCTTAGATACAAGAAACCTGAGTGCCAGAGTGA
CTGGCAGTGTCCAGGGAAGAAGAGATGTTGTCCTGACACTTGTGGCATCA
A
```

Expression of *Homo sapiens* Secretory Leukocyte Protease Inhibitor (Antileukoproteinase) Z25299 Transcripts which are Detectable by Amplicon as Depicted in Sequence Name Z25299_seg12-13WT (SEQ ID NO:447) in Normal and Cancerous Ovary Tissues Expression of *Homo sapiens* secretory leukocyte protease inhibitor (antileukoproteinase) transcripts detectable by or according to seg12-13WT—Z25299_seg12-13WT (SEQ ID NO:447) amplicon and primers Z25299_seg12-13WTF (SEQ ID NO:448) and Z25299_seg12-13WTR (SEQ ID NO:449) was measured by real time PCR. In parallel the expression of four housekeeping genes—SDHA (GenBank Accession No. NM_004168 (SEQ ID NO:364); amplicon—SDHA-amplicon (SEQ ID NO:365)), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)) and GAPDH (GenBank Accession No. BC026907 (SEQ ID NO:451); GAPDH (SEQ ID NO:450) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 45, 46, 71 and 48, Table 1 above), to obtain a value of fold up-regulation for each sample relative to median of the normal PM samples.

Figure 57:
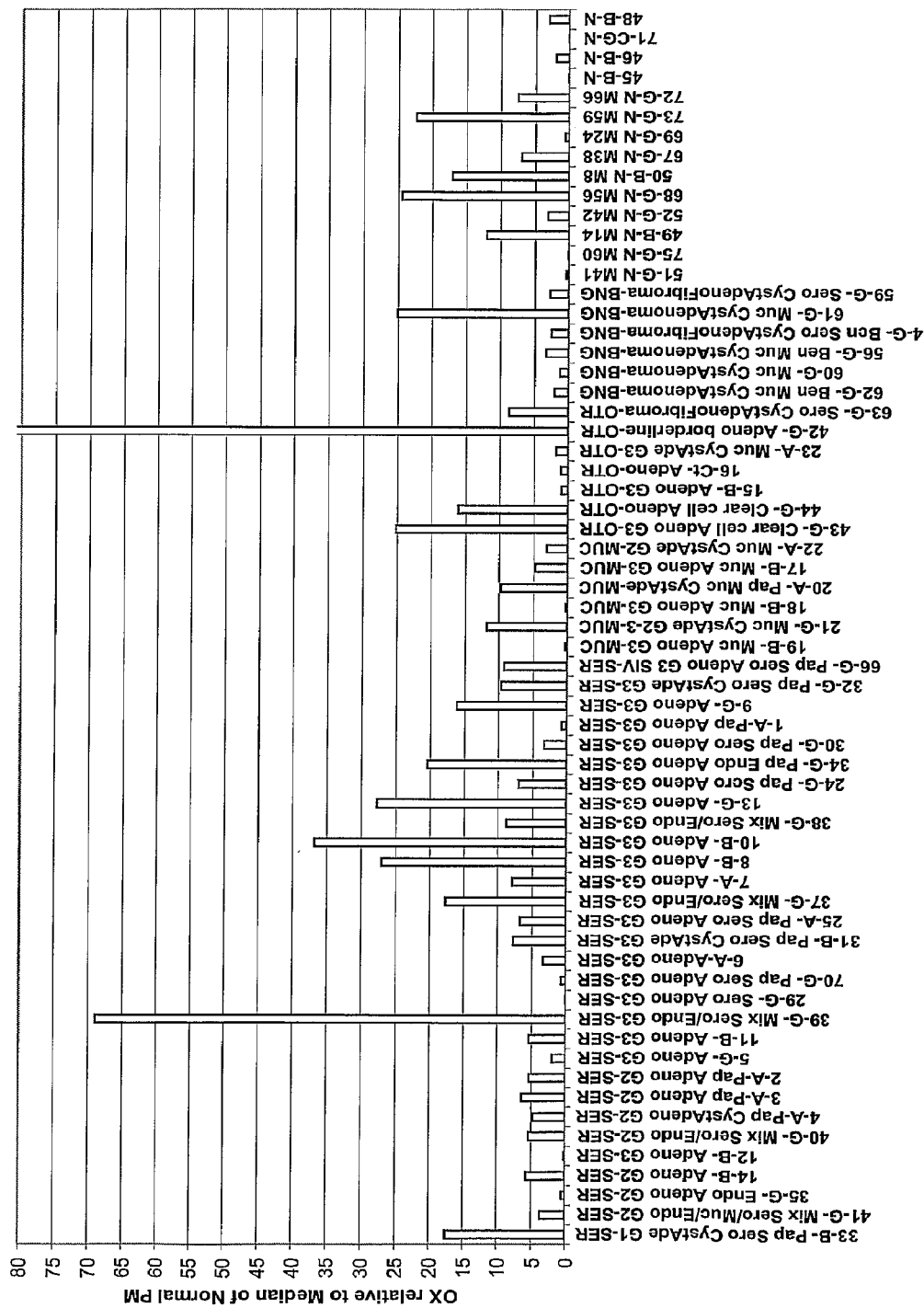
FIG. 57 is a histogram showing over expression of the *Homo sapiens* secretory leukocyte protease inhibitor (antileukoproteinase) Z25299 transcripts which are detectable by amplicon as depicted in sequence name Z25299_seg12-13WT (SEQ ID NO: 447) in cancerous Ovary samples relative to the normal samples.

FIG. 57 is a histogram showing over expression of the above-indicated *Homo sapiens* secretory leukocyte protease inhibitor (antileukoproteinase) transcripts in cancerous Ovary samples relative to the normal samples.

As is evident from FIG. 57, the expression of *Homo sapiens* secretory leukocyte protease inhibitor (antileukoproteinase) transcripts detectable by the above amplicon in adenocarcinoma samples was significantly higher than in the non-cancerous samples (sample numbers 45, 46, 71 and 48, Table 1 above). Notably an over-expression of at least 5 fold was found in 26 out of 43 adenocarcinoma samples, specifically in 20 out of 30 serous carcinoma samples, mainly in patients with age above 50, and in 2 out of 6 mucinous carcinoma samples.

Statistical analysis was applied to verify the significance of these results, as described below.

The P value for the difference in the expression levels of *Homo sapiens* secretory leukocyte protease inhibitor (antileukoproteinase) transcripts detectable by the above amplicon in Ovary serous carcinoma samples versus the normal tissue samples was determined by T test as 7.72e-004. The P value for the difference in the expression levels of *Homo sapiens* secretory leukocyte protease inhibitor (antileukoproteinase) transcripts detectable by the above amplicon in Ovary adenocarcinoma samples versus the normal tissue samples was determined by T test as 6.46e-004.

Threshold of 5 fold over expression was found to differentiate between serous carcinoma and normal samples with P value of 2.16e-002 as checked by exact Fisher test. Threshold of 5 fold over expression was found to differentiate between adenocarcinoma and normal samples with P value of 3.36e-002 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: Z25299_seg12-13WTF (SEQ ID NO:448) forward primer; and Z25299_seg12-13WTR (SEQ ID NO:449) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg12-13WT (SEQ ID NO:447).

```
Forward Primer (Z25299_seg12-13WTF
(SEQ ID NO: 448)):
AAGAAATCTGCCCAGTGCCT

Reverse Primer (Z25299_seg12-13WTR
(SEQ ID NO: 449)):
TTGATGCCACAAGTGTCAGGA

Amplicon (Z25299_seg12-13WT (SEQ ID NO: 447)):
AAGAAATCTGCCCAGTGCCTTAGATACAAGAAACCTGAGTGCCAGAGTGA
CTGGCAGTGTCCAGGGAAGAAGAGATGTTGTCCTGACACTTGTGGCATCA
A
```

Expression of Secretory Leukocyte Protease Inhibitor Acid-Stable Proteinase Inhibitor Z25299 Transcripts, which are Detectable by Amplicon as Depicted in Sequence Name Z25299 seg20 (SEQ ID NO: 452) in Normal and Cancerous Lung Tissues Expression of Secretory leukocyte protease inhibitor Acid-stable proteinase inhibitor transcripts detectable by or according to seg20, Z25299 seg20 (SEQ ID NO: 452) amplicon and Z25299 seg20F (SEQ ID NO: 453) and Z25299 seg20R (SEQ ID NO: 454) primers was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), UBC (GenBank Accession No. BC000449 (SEQ ID NO:366); amplicon—Ubiquitin-amplicon (SEQ ID NO:367)) and SDHA (GenBank Accession No. NM_004168 (SEQ ID NO:364); amplicon—SDHA-amplicon (SEQ ID NO:365)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 3, above)—these values are plotted in FIG. 58. Then the reciprocal of this ratio was calculated, to obtain a value of fold down-regulation for each sample relative to median of the normal PM samples—these values are plotted in FIG. 59.

Figure 58:
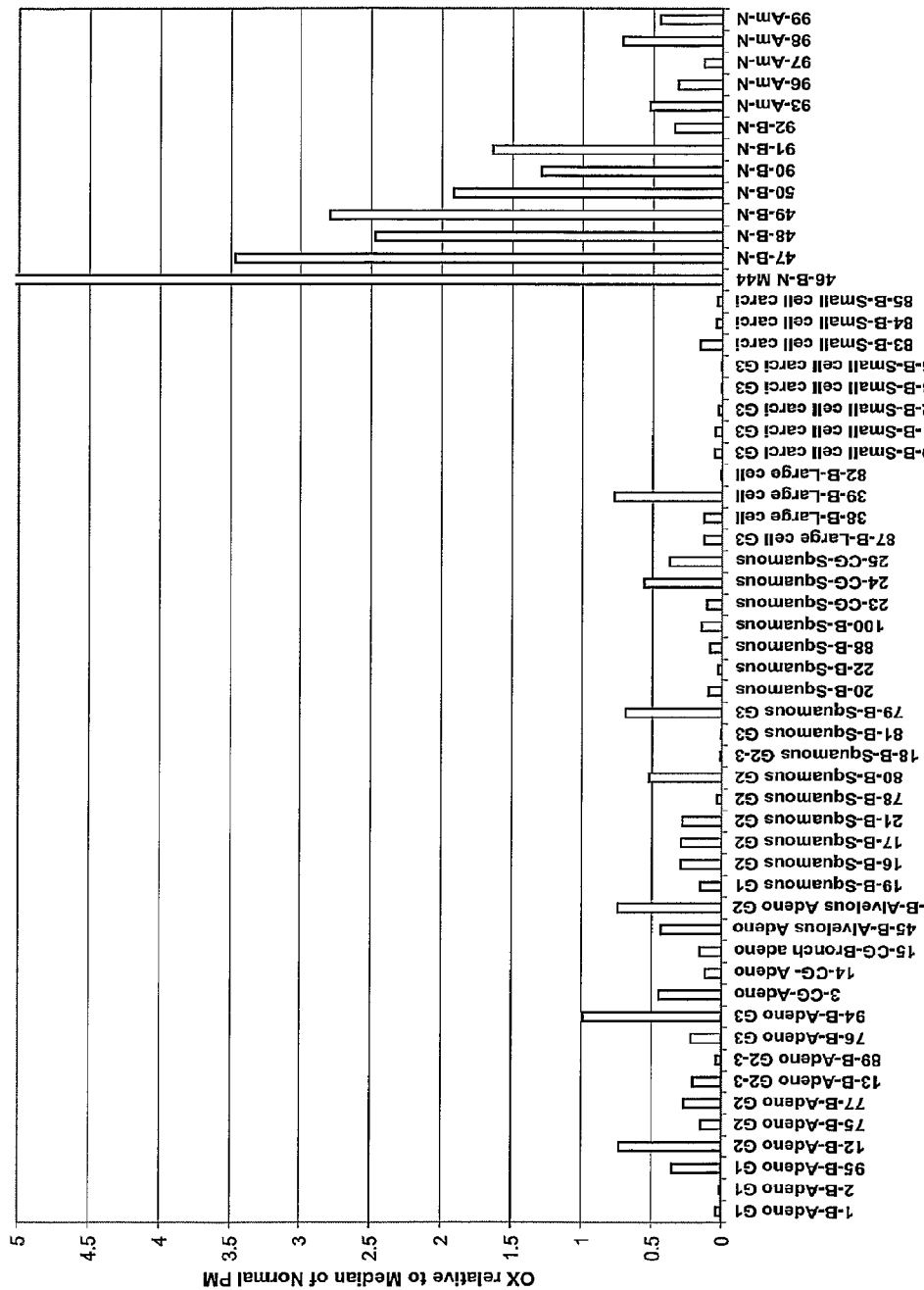
FIGS. 58 and 59 are histograms showing down regulation of the Secretory leukocyte protease inhibitor Acid-stable proteinase inhibitor transcripts, which are detectable by amplicon as depicted in sequence name Z25299 seg20 (SEQ ID NO: 452) in cancerous lung samples relative to the normal samples.
Figure 59:
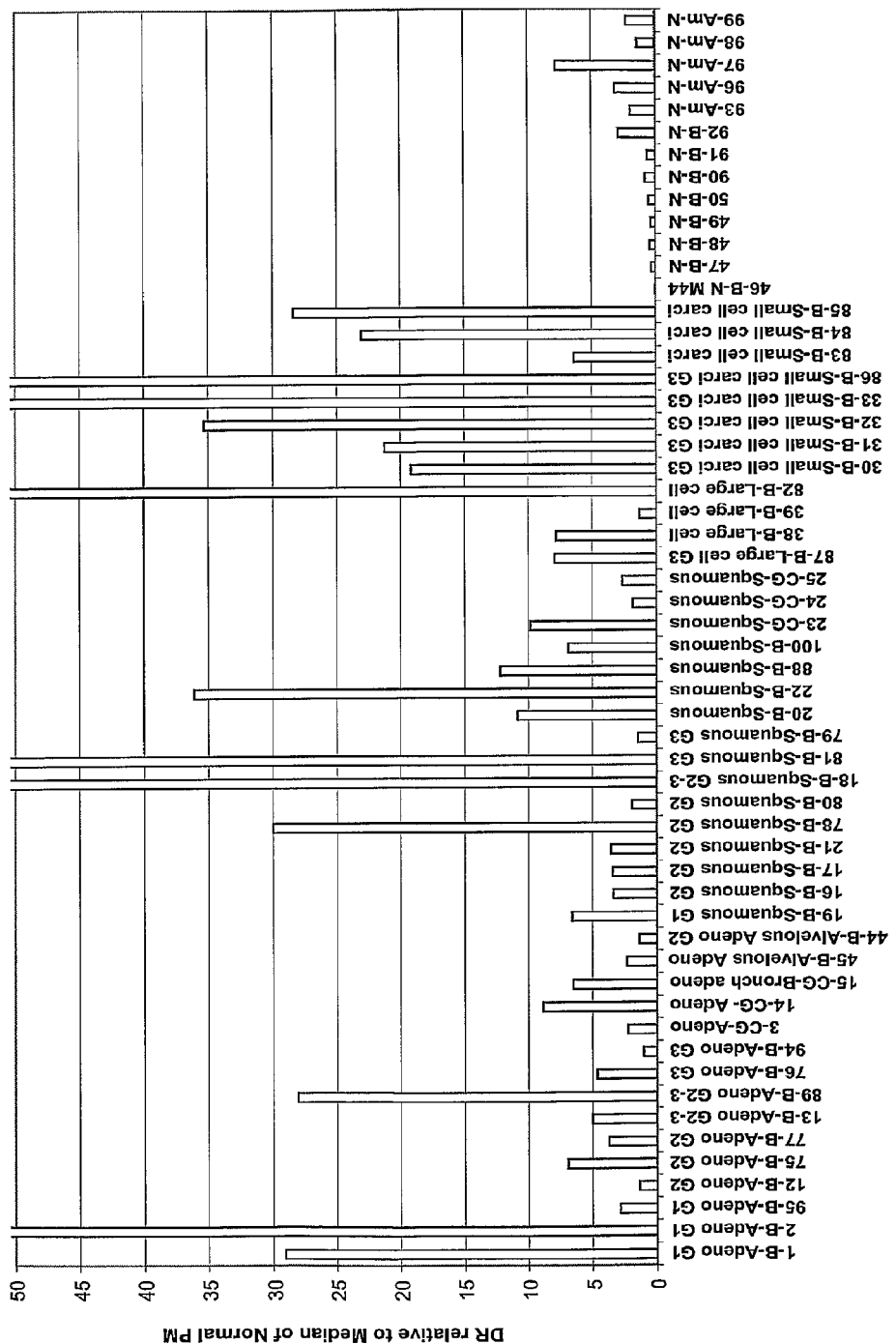

FIGS. 58 and 59 are histograms showing down regulation of the above-indicated Secretory leukocyte protease inhibitor Acid-stable proteinase inhibitor transcripts in cancerous lung samples relative to the normal samples.

As is evident from FIGS. 58 and 59, the expression of Secretory leukocyte protease inhibitor Acid-stable proteinase inhibitor transcripts detectable by the above amplicon(s) in cancer samples was significantly lower than in the non-cancerous samples (Sample Nos. 47-50, 90-93, 96-99 Table 3). Notably down regulation of at least 5 fold was found in 6 out of 15 adenocarcinoma samples, 9 out of 16 squamous cell carcinoma samples, 3 out of 4 large cell carcinoma samples and in 8 out of 8 small cells carcinoma samples.

Statistical analysis was applied to verify the significance of these results, as described below.

The P value for the difference in the expression levels of Secretory leukocyte protease inhibitor Acid-stable proteinase inhibitor transcripts detectable by the above amplicon in lung cancer samples versus the normal tissue samples was determined by T test as 9.43E-02 in adenocarcinoma, 5.62E-02 in squamous cell carcinoma, 3.38E-01 in large cell carcinoma and 3.78E-02 in small cell carcinoma.

Threshold of 5 fold down regulation was found to differentiate between cancer and normal samples with P value of 3.73E-02 in adenocarcinoma, 1.10E-02 in squamous cell carcinoma, 2.64E-02 in large cell carcinoma and 7.14E-05 in small cell carcinomas checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg20F (SEQ ID NO: 453) forward primer; and Z25299 seg20R (SEQ ID NO: 454) reverse primer.

The present invention also preferably encompasses any amplicon obtained through the use of any suitable primer pair; for example, for the above experiment, the following amplicon was obtained as a non-limiting illustrative example only of a suitable amplicon: Z25299 seg20 (SEQ ID NO: 452).

```
Forward primer (SEQ ID NO: 453):
CTCCTGAACCCTACTCCAAGCA

Reverse primer (SEQ ID NO: 454):
CAGGCGATCCTATGGAAATCC

Amplicon (SEQ ID NO: 452):
CTCCTGAACCCTACTCCAAGCACAGCCTCTGTCTGACTCCCTTGTCCTTC
AAGAGAACTGTTCTCCAGGTCTCAGGGCCAGGATTTCCATAGGATCGCCT
G
```

Expression of *Homo sapiens* Secretory Leukocyte Protease Inhibitor (Antileukoproteinase) Z25299 Transcripts which are Detectable by Amplicon as Depicted in Sequence Name Z25299_seg20 (SEQ ID NO: 452) in Different Normal Tissues Expression of *Homo sapiens* secretory leukocyte protease inhibitor (antileukoproteinase) transcripts detectable by or according to seg20—Z25299_seg20 (SEQ ID NO: 452) amplicon and primers Z25299_seg20F (SEQ ID NO: 453) and Z25299_seg20R (SEQ ID NO: 454) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the ovary samples (sample numbers 19 and 20, Table 5 above), to obtain a value of relative expression of each sample relative to median of the ovary samples.

Values represent the average of duplicate experiments. Error bars indicate the minimal and maximal values obtained.

```
Forward Primer (Z25299_seg20F (SEQ ID NO: 453)):
CTCCTGAACCCTACTCCAAGCA

Reverse Primer (Z25299_seg20R (SEQ ID NO: 454)):
CAGGCGATCCTATGGAAATCC

Amplicon (Z25299_seg20 (SEQ ID NO: 452)):
CTCCTGAACCCTACTCCAAGCACAGCCTCTGTCTGACTCCCTTGTCCTTC
AAGAGAACTGTTCTCCAGGTCTCAGGGCCAGGATTTCCATAGGATCGCCT
G
```

Figure 60:
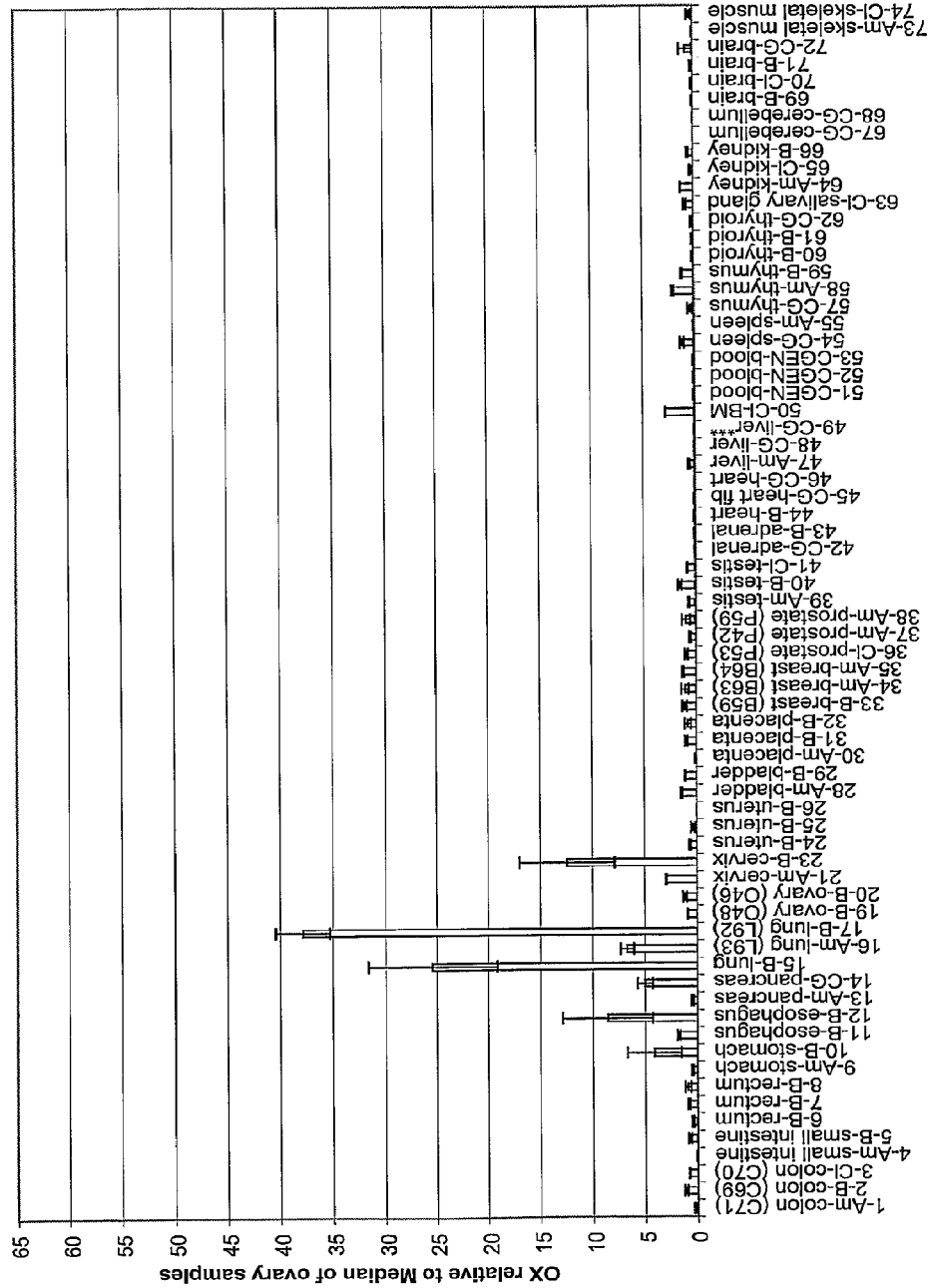
FIG. 60 is a histogram showing expression of the *Homo sapiens* secretory leukocyte protease inhibitor (antileukoproteinase) Z25299 transcripts which are detectable by amplicon as depicted in sequence name Z25299_seg20 (SEQ ID NO: 452) in different normal tissues.

FIG. 60 is a histogram showing expression of the *Homo sapiens* secretory leukocyte protease inhibitor (antileukoproteinase) Z25299 transcripts which are detectable by amplicon as depicted in sequence name Z25299_seg20 (SEQ ID NO: 452) in different normal tissues.

Expression of *Homo sapiens* Secretory Leukocyte Protease Inhibitor (Antileukoproteinase) Z25299 Transcripts which are Detectable by Amplicon as Depicted in Sequence Name Z25299_seg23 (SEQ ID NO:455) in Normal and Cancerous Colon Tissues Expression of *Homo sapiens* secretory leukocyte protease inhibitor (antileukoproteinase) transcripts detectable by or according to seg23—Z25299_seg23 (SEQ ID NO:455) amplicon and primers Z25299_seg23F (SEQ ID NO:456) and Z25299_seg23R (SEQ ID NO:457) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), RPS27A (GenBank Accession No. NM_002954 (SEQ ID NO:403); RPS27A (SEQ ID NO:402) amplicon) and G6PD (GenBank Accession No. NM_000402 (SEQ ID NO:405); G6PD (SEQ ID NO:404) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 41, 52, 62, 63, 64, 65, 66, 67, 69, 70 and 71, Table 2 above), to obtain a value of fold up-regulation for each sample relative to median of the normal PM samples.

Figure 61:
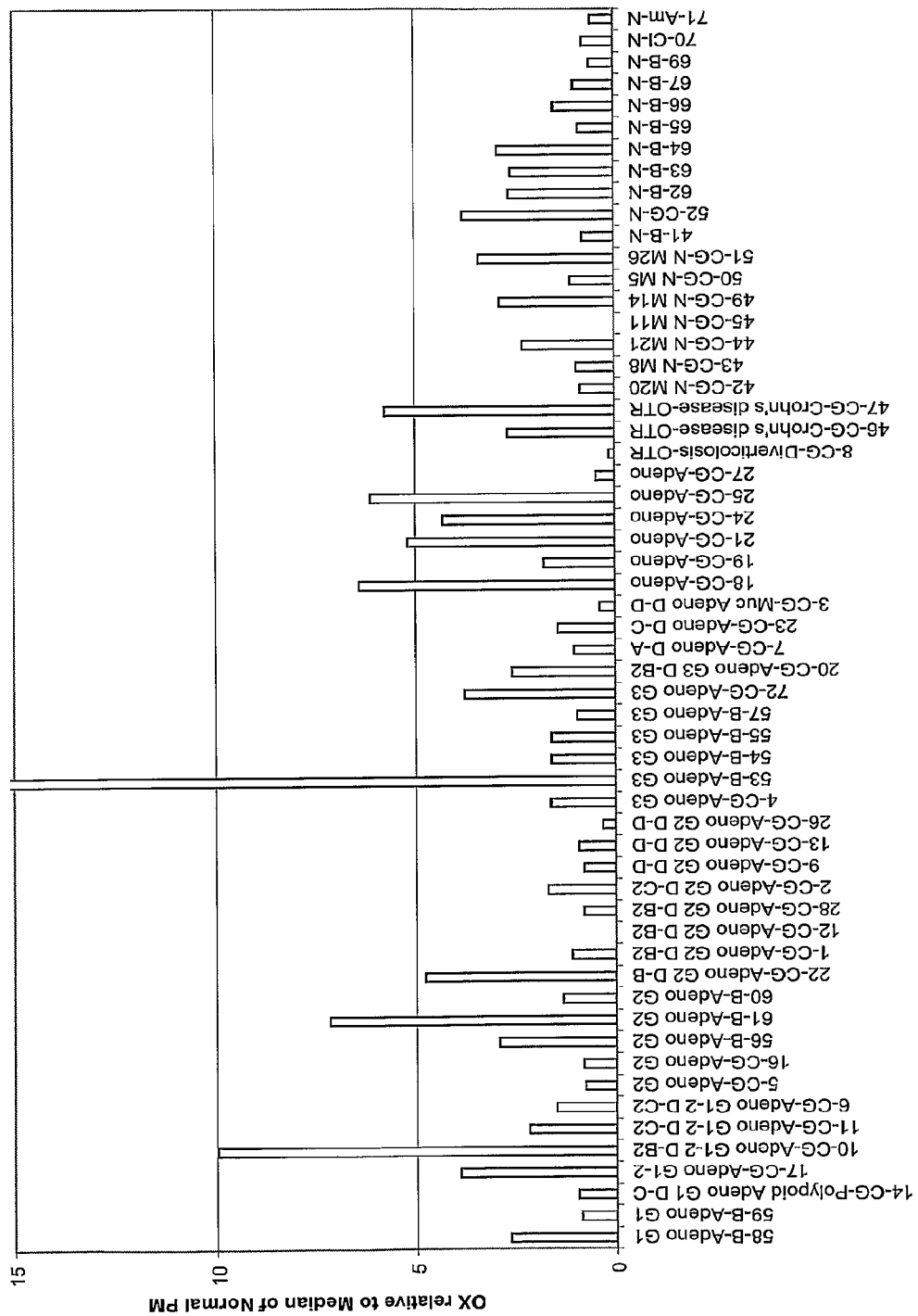
FIG. 61 is a histogram showing over expression of the *Homo sapiens* secretory leukocyte protease inhibitor (antileukoproteinase) Z25299 transcripts which are detectable by amplicon as depicted in sequence name Z25299_seg23 (SEQ ID NO: 455) in cancerous colon samples relative to the normal samples.

FIG. 61 is a histogram showing over expression of the above-indicated *Homo sapiens* secretory leukocyte protease inhibitor (antileukoproteinase) transcripts in cancerous Colon samples relative to the normal samples.

As is evident from FIG. 61, the expression of *Homo sapiens* secretory leukocyte protease inhibitor (antileukoproteinase) transcripts detectable by the above amplicon in cancer samples was higher than in the non-cancerous samples (sample numbers 41, 52, 62, 63, 64, 65, 66, 67, 69, 70 and 71, Table 2 above). Notably an over-expression of at least 5 fold was found in 6 out of 36 adenocarcinoma samples.

Primer pairs are also optionally and preferably encompassed within the present invention; for example, for the above experiment, the following primer pair was used as a non-limiting illustrative example only of a suitable primer pair: Z25299_seg23F (SEQ ID NO:456) forward primer; and Z25299_seg23R (SEQ ID NO:457) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg23 (SEQ ID NO:455).

```
Forward Primer (Z25299_seg23F (SEQ ID NO: 456)):
CAAGCAATTGAGGGACCAGG

Reverse Primer (Z25299_seg23R (SEQ ID NO: 457)):
CAAAAAACATTGTTAATGAGAGAGATGAC

Amplicon (Z25299_seg23 (SEQ ID NO: 455)):
CAAGCAATTGAGGGACCAGGAAGTGGATCCTCTAGAGATGAGGAGGCATT
CTGCTGGATGACTTTTAAAAATGTTTTCTCCAGAGTCATCTCTCTCATTA
ACAATGTTTTTG
```

Expression of *Homo sapiens* Secretory Leukocyte Protease Inhibitor (Antileukoproteinase) Z25299 Transcripts which are Detectable by Amplicon as Depicted in Sequence Name Z25299_seg23 (SEQ ID NO:455) in Normal and Cancerous Lung Tissues Expression of *Homo sapiens* secretory leukocyte protease inhibitor (antileukoproteinase) transcripts detectable by or according to seg23—Z25299_seg23 (SEQ ID NO:455) amplicon and primers Z25299_seg23F (SEQ ID NO:456) and Z25299_seg23R (SEQ ID NO:457) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), RPS27A (GenBank Accession No. NM_002954 (SEQ ID NO:403); RPS27A (SEQ ID NO:402) amplicon) and G6PD (GenBank Accession No. NM_000402 (SEQ ID NO:405); G6PD (SEQ ID NO:404) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold differential expression for each sample relative to median of the normal PM samples.

Figure 62:
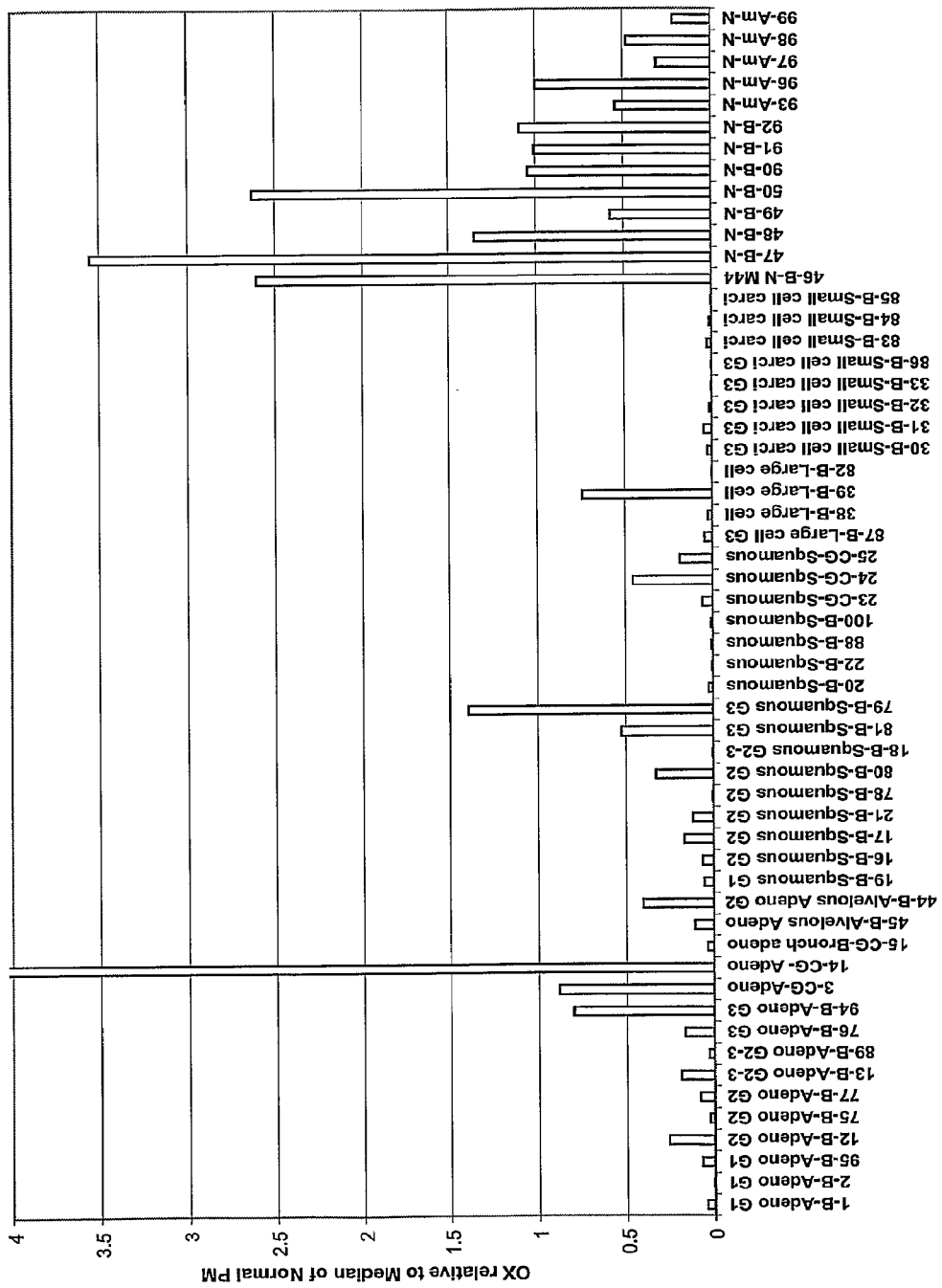
FIG. 62 is a histogram showing down regulation of the *Homo sapiens* secretory leukocyte protease inhibitor (antileukoproteinase) Z25299 transcripts which are detectable by amplicon as depicted in sequence name Z25299_seg23 (SEQ ID NO: 455) in cancerous lung samples relative to the normal samples.

FIG. 62 is a histogram showing down regulation of the above-indicated *Homo sapiens* secretory leukocyte protease inhibitor (antileukoproteinase) transcripts in cancerous lung samples relative to the normal samples.

As is evident from FIG. 62, the expression of *Homo sapiens* secretory leukocyte protease inhibitor (antileukoproteinase) transcripts detectable by the above amplicon in cancer samples, especially in the small cell carcinoma samples, was significantly lower than in the non-cancerous samples (sample numbers 47, 48, 49, 50, 90, 91, 92, 93, 96, 97, 98 and 99, Table 3 above).

Statistical analysis was applied to verify the significance of these results, as described below.

The P value for the difference in the expression levels of *Homo sapiens* secretory leukocyte protease inhibitor (antileukoproteinase) transcripts detectable by the above amplicon in lung cancer samples versus the normal tissue samples was determined by T test as 1.90E-3

This value demonstrates statistical significance of the results.

Primer pairs are also optionally and preferably encompassed within the present invention; for example, for the above experiment, the following primer pair was used as a non-limiting illustrative example only of a suitable primer pair: Z25299_seg23F (SEQ ID NO:456) forward primer; and Z25299_seg23R (SEQ ID NO:457) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg23 (SEQ ID NO:455).

```
Forward Primer (Z25299_seg23F (SEQ ID NO: 456)):
CAAGCAATTGAGGGACCAGG

Reverse Primer (Z25299_seg23R (SEQ ID NO: 457)):
CAAAAAACATTGTTAATGAGAGAGATGAC

Amplicon (Z25299_seg23 (SEQ ID NO: 455)):
CAAGCAATTGAGGGACCAGGAAGTGGATCCTCTAGAGATGAGGAGGCATT
CTGCTGGATGACTTTTAAAAATGTTTTCTCCAGAGTCATCTCTCTCATTAA
CAATGTTTTTG
```

Expression of *Homo sapiens* Secretory Leukocyte Protease Inhibitor (Antileukoproteinase) Z25299 Transcripts which are Detectable by Amplicon as Depicted in Sequence Name Z25299_seg23 (SEQ ID NO:455) in Different Normal Tissues Expression of *Homo sapiens* secretory leukocyte protease inhibitor (antileukoproteinase) transcripts detectable by or according to seg23—Z25299_seg23 (SEQ ID NO:455) amplicon and primers Z25299_seg23F (SEQ ID NO:456) and Z25299_seg23R (SEQ ID NO:457) was measured by real time PCR. In parallel the expression of four housekeeping genes—SDHA (GenBank Accession No. NM_004168 (SEQ ID NO:364); amplicon—SDHA-amplicon (SEQ ID NO:365)), Ubiquitin (GenBank Accession No. BC000449 (SEQ ID NO:366); amplicon—Ubiquitin-amplicon (SEQ ID NO:367)), RPL19 (GenBank Accession No. NM_000981 (SEQ ID NO:369); RPL19 (SEQ ID NO:368) amplicon) and TATA box (GenBank Accession No. NM_003194 (SEQ ID NO:371); TATA (SEQ ID NO:370) amplicon) was measured similarly. For each RT sample, the expression of the above amplicon was normalized to the geometric mean of the quantities of the housekeeping genes. The normalized quantity of each RT sample was then divided by the median of the quantities of the ovary samples (sample numbers 19 and 20, Table 5 above), to obtain a value of relative expression of each sample relative to median of the ovary samples.

Values represent the average of duplicate experiments. Error bars indicate the minimal and maximal values obtained.

```
Forward Primer (Z25299_seg23F (SEQ ID NO: 456)):
CAAGCAATTGAGGGACCAGG

Reverse Primer (Z25299_seg23R (SEQ ID NO: 457)):
CAAAAAACATTGTTAATGAGAGAGATGAC

Amplicon (Z25299_seg23 (SEQ ID NO: 455)):
CAAGCAATTGAGGGACCAGGAAGTGGATCCTCTAGAGATGAGGAGGCATT
CTGCTGGATGACTTTTAAAAATGTTTTCTCCAGAGTCATCTCTCTCATTA
ACAATGTTTTTG
```

Figure 63:
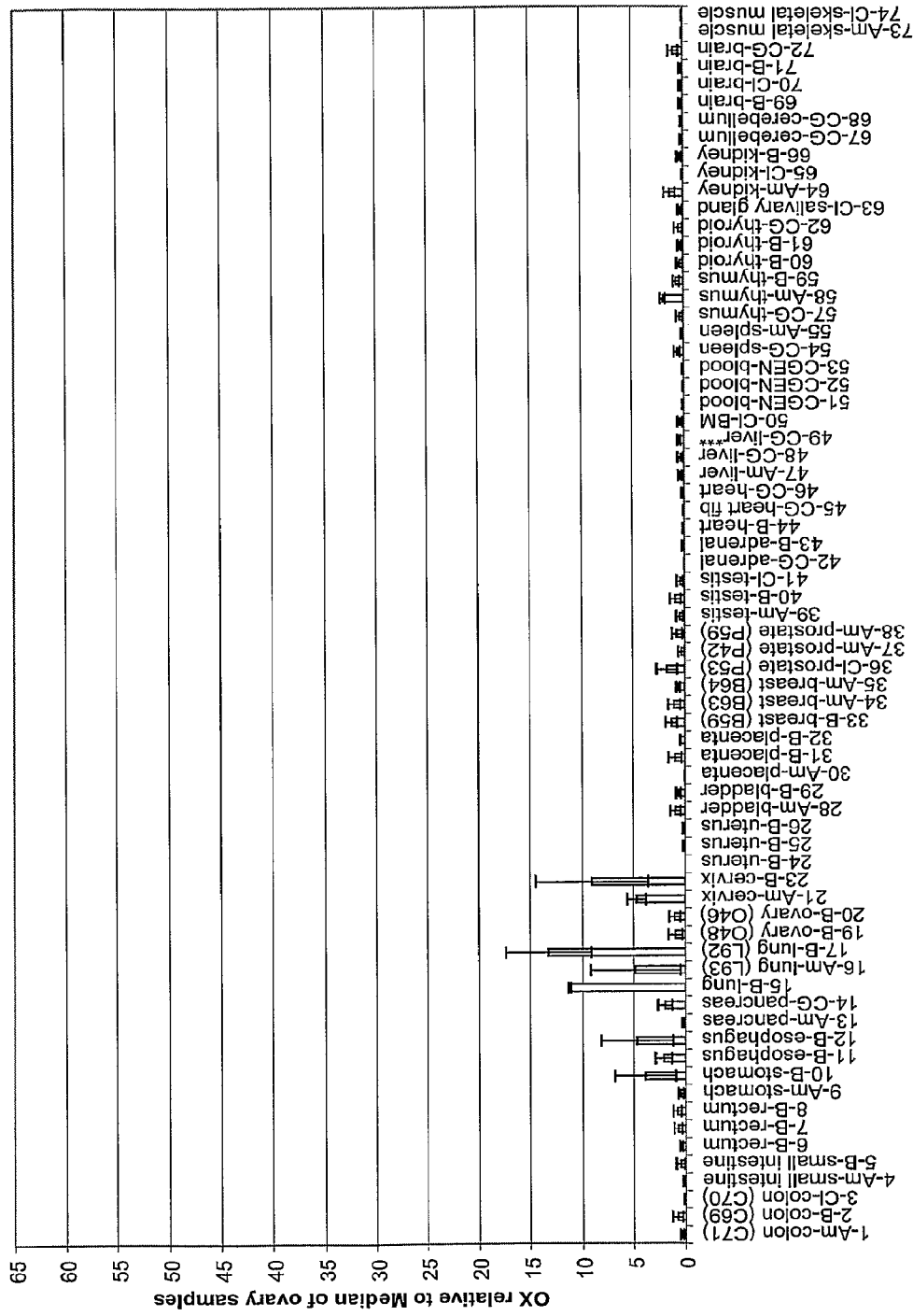
FIG. 63 is a histogram showing expression of the *Homo sapiens* secretory leukocyte protease inhibitor (antileukoproteinase) Z25299 transcripts which are detectable by amplicon as depicted in sequence name Z25299_seg23 (SEQ ID NO: 455) in different normal samples.

FIG. 63 is a histogram showing expression of the *Homo sapiens* secretory leukocyte protease inhibitor (antileukoproteinase) Z25299 transcripts which are detectable by amplicon as depicted in sequence name Z25299_seg23 (SEQ ID NO: 455) in different normal samples.

Expression of Secretory Leukocyte Protease Inhibitor Acid-Stable Proteinase Inhibitor Z25299 Transcripts which are Detectable by Amplicon as Depicted in Sequence Name Z25299_junc13-14-21 (SEQ ID NO: 444) in Normal and Cancerous Ovary Tissues Expression of Secretory leukocyte protease inhibitor Acid-stable proteinase transcripts detectable by or according to junc13-14-21, Z25299 junc13-14-21 (SEQ ID NO: 444) amplicon and Z25299 junc13-14-21F (SEQ ID NO: 445) and Z25299 junc13-14-21R (SEQ ID NO: 446) primers was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), SDHA (GenBank Accession No. NM_004168 (SEQ ID NO:364); amplicon—SDHA-amplicon (SEQ ID NO:365)), and GAPDH (GenBank Accession No. BC026907 (SEQ ID NO:451); GAPDH (SEQ ID NO:450) amplicon was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45, 46, 48, 71 Table 1 above), to obtain a value of fold up-regulation for each sample relative to median of the normal PM samples.

Figure 64:
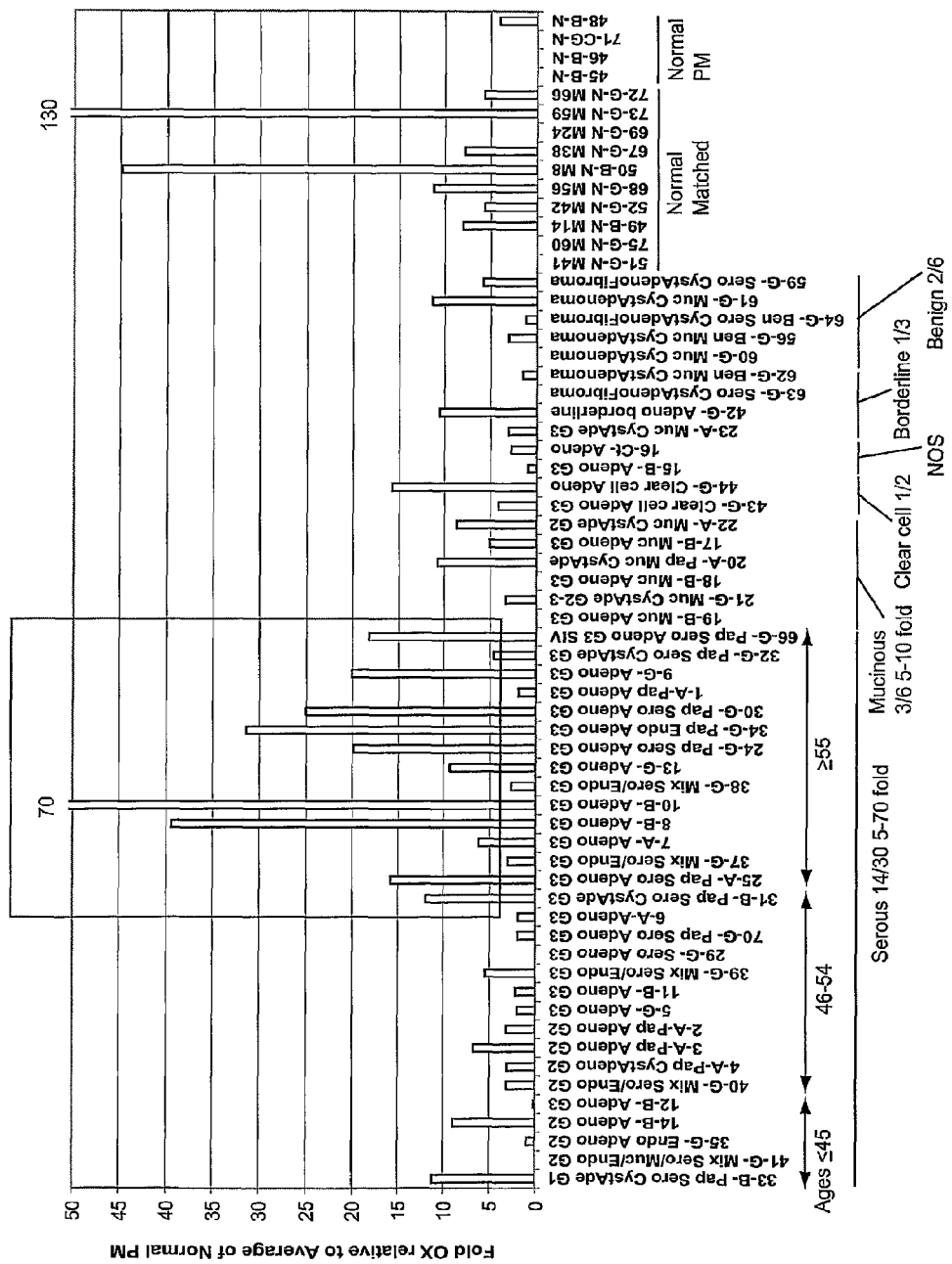
FIG. 64 is a histogram showing over expression of Z25299 junc13-14-21 (SEQ ID NO: 444) transcripts in cancerous ovary samples relative to the normal samples.

FIG. 64 is a histogram showing over expression of the above-indicated Secretory leukocyte protease inhibitor Acid-stable proteinase inhibitor transcripts in cancerous ovary samples relative to the normal samples. The number of samples that exhibit at least 5 fold over-expression, out of the total number of samples tested is indicated in the bottom.

As is evident from FIG. 64, the expression of Secretory leukocyte protease inhibitor Acid-stable proteinase inhibitor transcripts detectable by the above amplicon in cancer samples was significantly higher than in the non-cancerous samples (Sample Nos. 45, 46, 48, 71 Table 1). Notably an over-expression of at least 5 fold was found in 14 out of 30 serous adenocarcinoma, with the highest expression in samples from patients with age above 50, and in 3 out of 6 mucinus adenocarcinoma samples and in 1 out of the 2 clear cell samples.

Statistical analysis was applied to verify the significance of these results, as described below.

The P value for the difference in the expression levels of Secretory leukocyte protease inhibitor Acid-stable proteinase inhibitor transcripts detectable by the above amplicon in Ovary adenocarcinoma samples versus the non-cancerous tissue samples was determined by T test as 6.76e-03.

The above values demonstrate statistical significance of the results.

Primer pairs are also optionally and preferably encompassed within the present invention; for example, for the above experiment, the following primer pair was used as a non-limiting illustrative example only of a suitable primer pair: Z25299 junc13-14-21F (SEQ ID NO: 445) forward primer; and Z25299 junc13-14-21R (SEQ ID NO: 446) reverse primer.

The present invention also preferably encompasses any amplicon obtained through the use of any suitable primer pair; for example, for the above experiment, the following amplicon was obtained as a non-limiting illustrative example only of a suitable amplicon: Z25299_junc13-14-21 (SEQ ID NO: 444).

```
Forward primer (SEQ ID NO: 445):
ACCCCAAACCCAACTTGATTC

Reverse primer (SEQ ID NO: 446):
TCAGTGGTGGAGCCAAGTCTC

Amplicon (SEQ ID NO: 444):
ACCCCAAACCCAACTTGATTCCTGCCATATGGAGGAGGCTCTGGAGTCCT
GCTCTGTGTGGTCCAGGTCCTTTCCACCCTGAGACTTGGCTCCACCACTG
A
```

Expression of Secretory Leukocyte Protease Inhibitor Acid-Stable Proteinase Inhibitor Z25299 Transcripts, which are Detectable by Amplicon as Depicted in Sequence Name Z25299 seg20 (SEQ ID NO: 452) in Normal and Cancerous Ovary Tissues Expression of Secretory leukocyte protease inhibitor Acid-stable proteinase inhibitor transcripts detectable by or according to seg20, Z25299 seg20 amplicon (SEQ ID NO: 452) and Z25299 seg20F (SEQ ID NO: 453) and Z25299 seg20R (SEQ ID NO: 454) primers was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379);

amplicon—HPRT1-amplicon (SEQ ID NO:380)), SDHA (GenBank Accession No. NM_004168 (SEQ ID NO:364); amplicon—SDHA-amplicon (SEQ ID NO:365)), and GAPDH (GenBank Accession No. BC026907 (SEQ ID NO:451); GAPDH (SEQ ID NO:450) amplicon was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45, 46, 48, 71 Table 1, above), to obtain a value of fold up-regulation for each sample relative to median of the normal PM samples.

Figure 65:
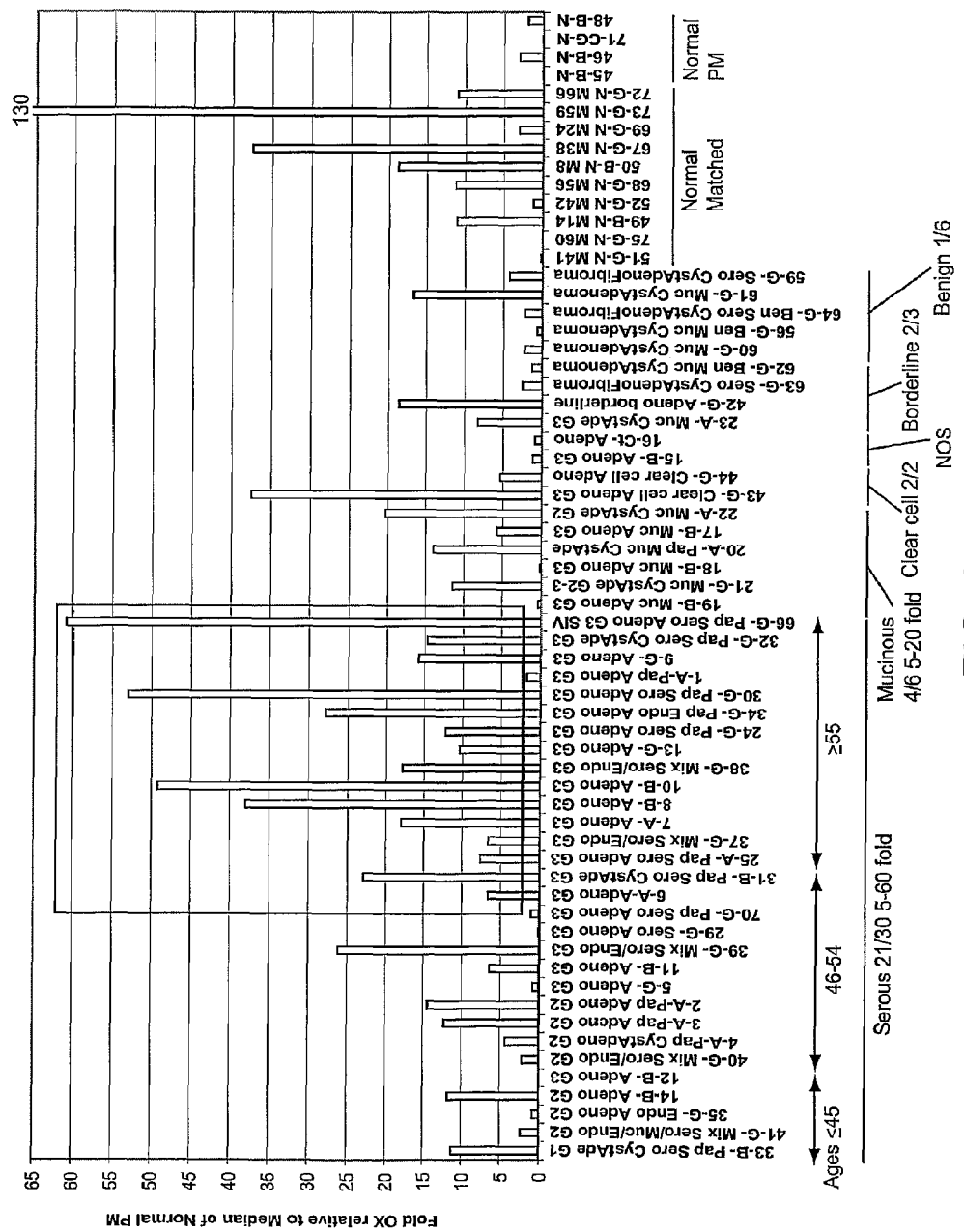
FIG. 65 is a histogram showing over expression of Z25299 seg20 (SEQ ID NO: 452) transcripts in cancerous ovary samples relative to the normal samples.

FIG. 65 is a histogram showing over expression of the above-indicated Secretory leukocyte protease inhibitor Acid-stable proteinase transcripts in cancerous ovary samples relative to the normal samples. The number of samples that exhibit at least 5 fold over-expression, out of the total number of samples tested is indicated in the bottom.

As is evident from FIG. 65, the expression of Secretory leukocyte protease inhibitor Acid-stable proteinase inhibitor transcripts detectable by the above amplicon in cancer samples was significantly higher than in the non-cancerous samples (Sample Nos. 45, 46, 48, 71 Table 1). Notably an over-expression of at least 5 fold was found in 21 out of 30 serous adenocarcinoma, with the highest expression in samples from patients with age above 50, and in 4 out of 6 mucinus adenocarcinoma samples and in 2 out of the 2 clear cell samples.

Statistical analysis was applied to verify the significance of these results, as described below.

The P value for the difference in the expression levels of Secretory leukocyte protease inhibitor Acid-stable proteinase inhibitor transcripts detectable by the above amplicon in Ovary adenocarcinoma samples versus the non-cancerous (benign and normal) tissue samples was determined by T test as 4.97e-04.

Threshold of 5 fold over expression was found to differentiate between adenocarcinoma and non-cancerous samples (benign and normal) with P value of 1.32e-03 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg20F (SEQ ID NO: 453) forward primer; and Z25299 seg20R (SEQ ID NO: 454) reverse primer.

The present invention also preferably encompasses any amplicon obtained through the use of any suitable primer pair; for example, for the above experiment, the following amplicon was obtained as a non-limiting illustrative example only of a suitable amplicon: Z25299 seg20 (SEQ ID NO: 452).

```
Forward primer (SEQ ID NO: 453):
CTCCTGAACCCTACTCCAAGCA

Reverse primer (SEQ ID NO: 454):
CAGGCGATCCTATGGAAATCC

Amplicon (SEQ ID NO: 452):
CTCCTGAACCCTACTCCAAGCACAGCCTCTGTCTGACTCCCTTGTCCTTC
AAGAGAACTGTTCTCCAGGTCTCAGGGCCAGGATTTCCATAGGATCGCCT
G
```

Expression of Secretory Leukocyte Protease Inhibitor Acid-Stable Proteinase Inhibitor Z25299 Transcripts, which are Detectable by Amplicon as Depicted in Sequence Name Z25299 seg23 (SEQ ID NO: 455) in Normal and Cancerous Ovary Tissues Expression of Secretory leukocyte protease inhibitor Acid-stable proteinase inhibitor transcripts detectable by or according to seg23, Z25299 seg23 (SEQ ID NO: 455) amplicon and Z25299 seg23F (SEQ ID NO: 456) and Z25299 seg23R (SEQ ID NO: 457) primers was measured by real time PCR. In parallel the expression of four housekeeping genes—PBGD (GenBank Accession No. BC019323 (SEQ ID NO:381); amplicon—PBGD-amplicon (SEQ ID NO:382)), HPRT1 (GenBank Accession No. NM_000194 (SEQ ID NO: 379); amplicon—HPRT1-amplicon (SEQ ID NO:380)), SDHA (GenBank Accession No. NM_004168 (SEQ ID NO:364); amplicon—SDHA-amplicon (SEQ ID NO:365)), and GAPDH (GenBank Accession No. BC026907 (SEQ ID NO:451); GAPDH (SEQ ID NO:450) amplicon was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45, 46, 48, 71 Table 1, above), to obtain a value of fold up-regulation for each sample relative to median of the normal PM samples.

Figure 66:
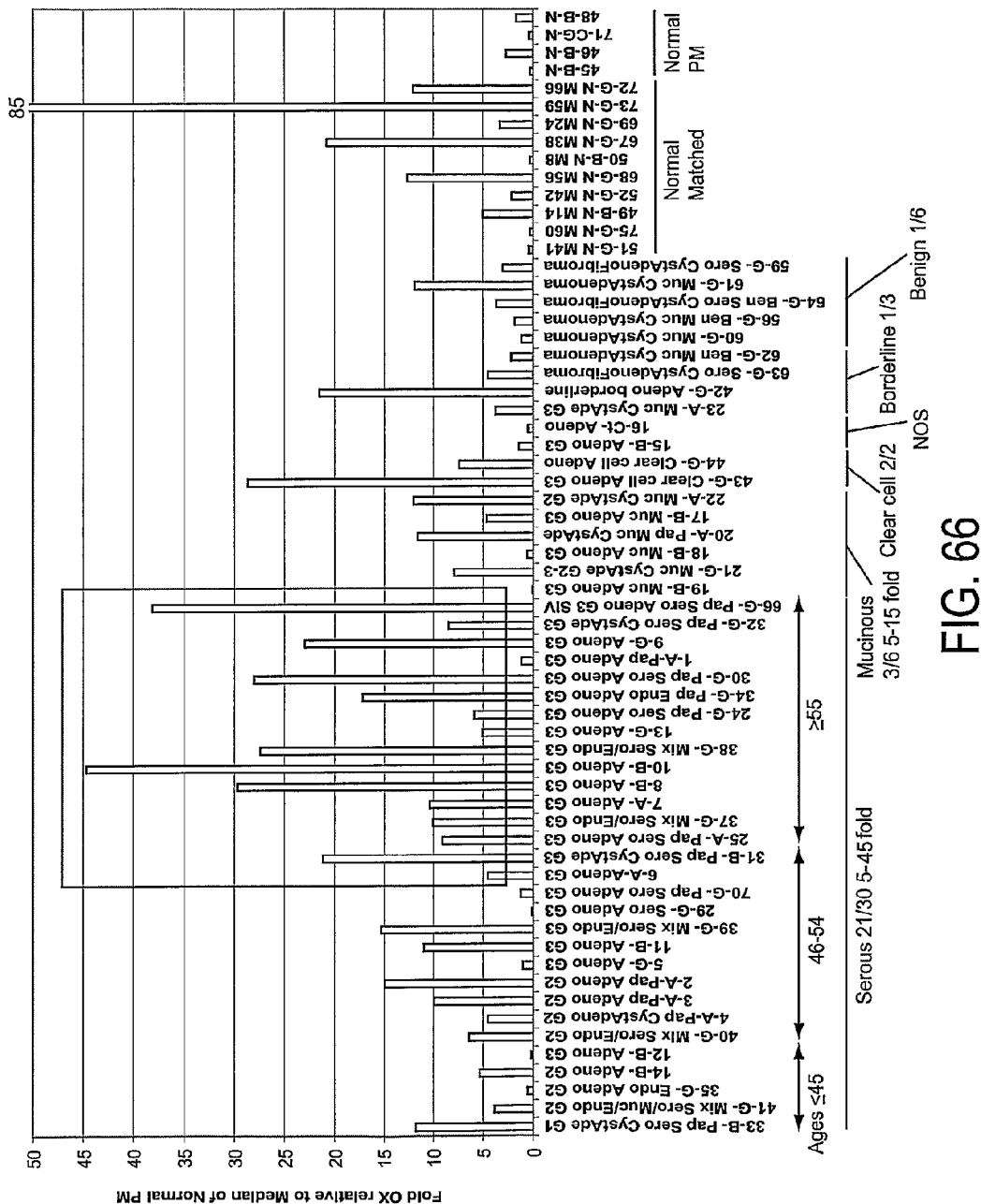
FIG. 66 is a histogram showing over expression of Z25299 seg23 (SEQ ID NO: 455) transcripts in cancerous ovary samples relative to the normal samples.

FIG. 66 is a histogram showing over expression of the above-indicated Secretory leukocyte protease inhibitor Acid-stable proteinase inhibitor transcripts in cancerous ovary samples relative to the normal samples. The number of samples that exhibit at least 5 fold over-expression, out of the total number of samples tested is indicated in the bottom.

As is evident from FIG. 66, the expression of Secretory leukocyte protease inhibitor Acid-stable proteinase inhibitor transcripts detectable by the above amplicon in cancer samples was significantly higher than in the non-cancerous samples (Sample Nos. 45, 46, 48, 71 Table 1). Notably an over-expression of at least 5 fold was found in 21 out of 30 serous adenocarcinoma, with the highest expression in samples from patients with age above 50, and in 3 out of 6 mucinus adenocarcinoma samples and in 2 out of the 2 clear cell samples.

Statistical analysis was applied to verify the significance of these results, as described below.

The P value for the difference in the expression levels of Secretory leukocyte protease inhibitor Acid-stable proteinase inhibitor transcripts detectable by the above amplicon in Ovary adenocarcinoma samples versus the non-cancerous tissue samples was determined by T test as 1.42e-04.

Threshold of 5 fold over expression was found to differentiate between adenocarcinoma and non-cancerous samples with P value of 3.10e-03 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg23F (SEQ ID NO: 456) forward primer; and Z25299 seg23R (SEQ ID NO: 457) reverse primer.

The present invention also preferably encompasses any amplicon obtained through the use of any suitable primer pair; for example, for the above experiment, the following amplicon was obtained as a non-limiting illustrative example only of a suitable amplicon: Z25299 seg23 (SEQ ID NO: 455).

Forward primer (SEQ ID NO: 456):
CAAGCAATTGAGGGACCAGG

Reverse primer (SEQ ID NO: 457):
CAAAAAACATTGTTAATGAGAGAGATGAC

Amplicon (Seq id no: 455):
CAAGCAATTGAGGGACCAGGAAGTGGATCCTCTAGAGATGAGGAGGCATT
CTGCTGGATGACTTTTAAAAATGTTTTCTCCAGAGTCATCTCTCTCATTA
ACAATGTTTTTG Expression of *Homo sapiens* Secretory Leukocyte Protease Inhibitor (Antileukoproteinase) Z25299 Transcripts which are Detectable by Amplicon as Depicted in Sequence Name Z25299_junc13-14-21 (SEQ ID NO: 444) in Normal and Cancerous Lung Tissues Expression of *Homo sapiens* secretory leukocyte protease inhibitor (antileukoproteinase) transcripts detectable by or according to junc13-14-21—Z25299_junc13-14-21 (SEQ ID NO: 444) amplicon and primers Z25299_junc13-14-21-F (SEQ ID NO: 445) and junc13-14-21-R (SEQ ID NO: 446) was measured by real time PCR. In parallel the expression of four housekeeping genes—SDHA (GenBank Accession No. NM_004168 (SEQ ID NO:364); amplicon—SDHA-amplicon (SEQ ID NO:365)), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)) and GAPDH (GenBank Accession No. BC026907 (SEQ ID NO:451); GAPDH (SEQ ID NO:450) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 47, 48, 49, 50, 90, 91, 92, 93, 96, 97, 98 and 99, Table 3 above), to obtain a value of fold differential expression for each sample relative to median of the normal PM samples—these values are plotted in FIG. 67.

Figure 67:
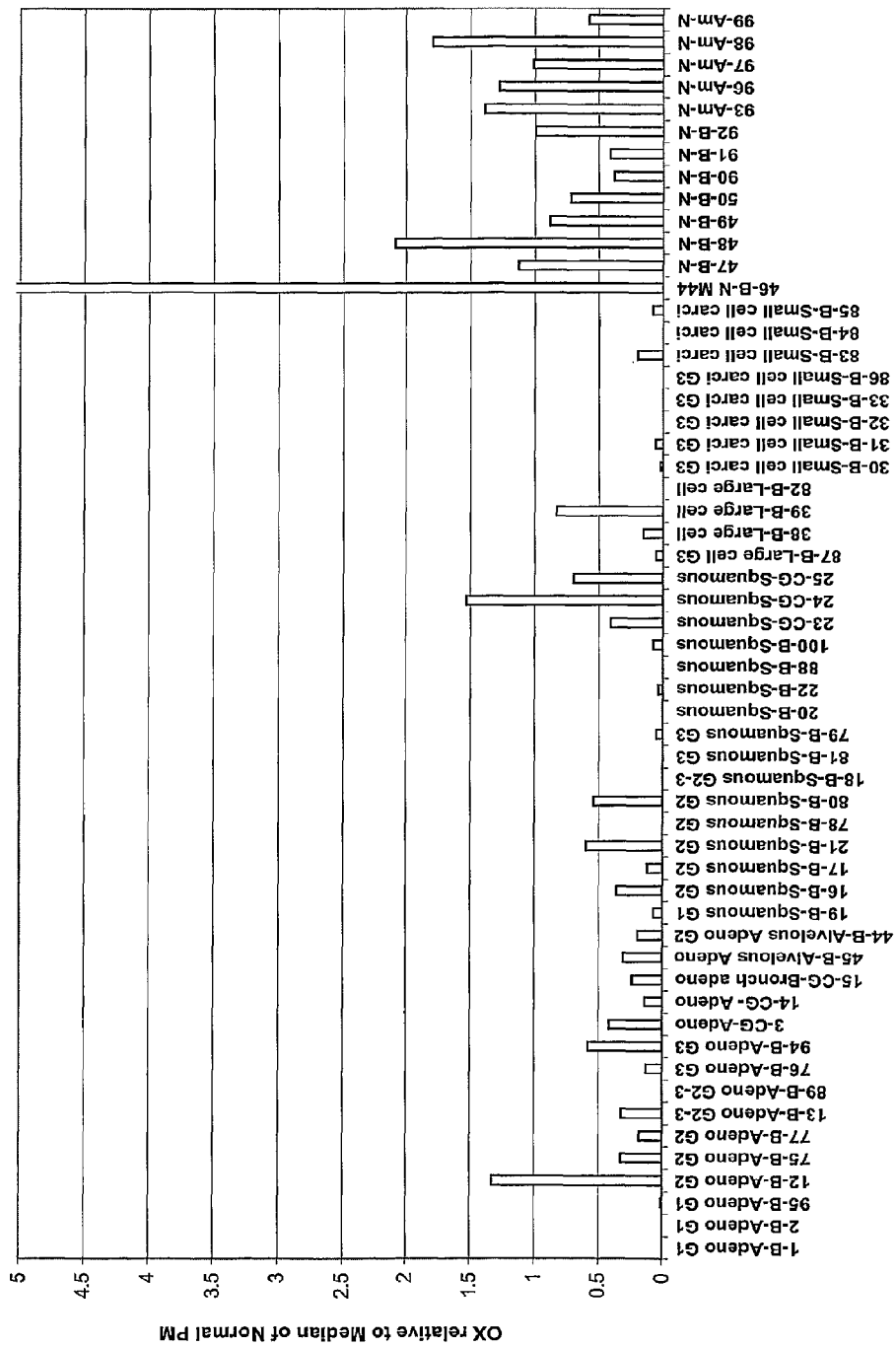
FIG. 67 is a histogram showing down regulation of the *Homo sapiens* secretory leukocyte protease inhibitor (antileukoproteinase) Z25299 transcripts which are detectable by amplicon as depicted in sequence name Z25299_junc13-14-21 (SEQ ID NO: 444) in cancerous lung tissues relative to the normal samples.

FIG. 67 is a histogram showing down regulation of the above-indicated *Homo sapiens* secretory leukocyte protease inhibitor (antileukoproteinase) transcripts in cancerous lung samples relative to the normal samples.

As is evident from FIG. 67, the expression of *Homo sapiens* secretory leukocyte protease inhibitor (antileukoproteinase) transcripts detectable by the above amplicon in cancer samples, mainly in the small cell carcinoma was lower than in the non-cancerous samples (sample numbers 47, 48, 49, 50, 90, 91, 92, 93, 96, 97, 98 and 99, Table 3 above).

Statistical analysis was applied to verify the significance of these results, as described below.

The P value for the difference in the expression levels of *Homo sapiens* secretory leukocyte protease inhibitor (antileukoproteinase) transcripts detectable by the above amplicon in lung cancerous samples versus the normal tissue samples was determined by T test as 1.98e-04. This value demonstrate statistical significance of the results.

Primer pairs are also optionally and preferably encompassed within the present invention; for example, for the above experiment, the following primer pair was used as a non-limiting illustrative example only of a suitable primer pair: Z25299_junc13-14-21F (SEQ ID NO: 445) forward primer; and Z25299_junc13-14-21R (SEQ ID NO: 446) reverse primer.

The present invention also preferably encompasses any amplicon obtained through the use of any suitable primer pair; for example, for the above experiment, the following amplicon was obtained as a non-limiting illustrative example only of a suitable amplicon: Z25299_junc13-14-21 (SEQ ID NO: 444).

Forward Primer (Z25299_junc13-14-21F
(SEQ ID NO: 445)):
ACCCCAAACCCAACTTGATTC

Reverse Primer (Z25299_junc13-14-21R
(SEQ ID NO: 446)):
TCAGTGGTGGAGCCAAGTCTC

Amplicon (Z25299_seg13-14-21 (SEQ ID NO: 444):
ACCCCAAACCCAACTTGATTCCTGCCATATGGAGGAGGCTCTGGAGTCCT
GCTCTGTGTGGTCCAGGTCCTTTCCACCCTGAGACTTGGCTCCACCACTG
A Expression of *Homo sapiens* Secretory Leukocyte Protease Inhibitor (Antileukoproteinase) Z25299 Transcripts which are Detectable by Amplicon as Depicted in Sequence Name Z25299_seg20 (SEQ ID NO: 452) in Normal and Cancerous Colon Tissues Expression of *Homo sapiens* secretory leukocyte protease inhibitor (antileukoproteinase) transcripts detectable by or according to seg20—Z25299_seg20 (SEQ ID NO: 452) amplicon and primers Z25299_seg20F (SEQ ID NO: 453) and Z25299_seg20R (SEQ ID NO: 454) was measured by real time PCR. In parallel the expression of four housekeeping genes—HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)), RPS27A (GenBank Accession No. NM_002954 (SEQ ID NO:403); RPS27A (SEQ ID NO:402) amplicon) and G6PD (GenBank Accession No. NM_000402 (SEQ ID NO:405); G6PD (SEQ ID NO:404) amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 41, 52, 62, 63, 64, 65, 66, 67, 69, 70 and 71, Table 2 above), to obtain a value of fold up-regulation for each sample relative to median of the normal PM samples.

Figure 68:
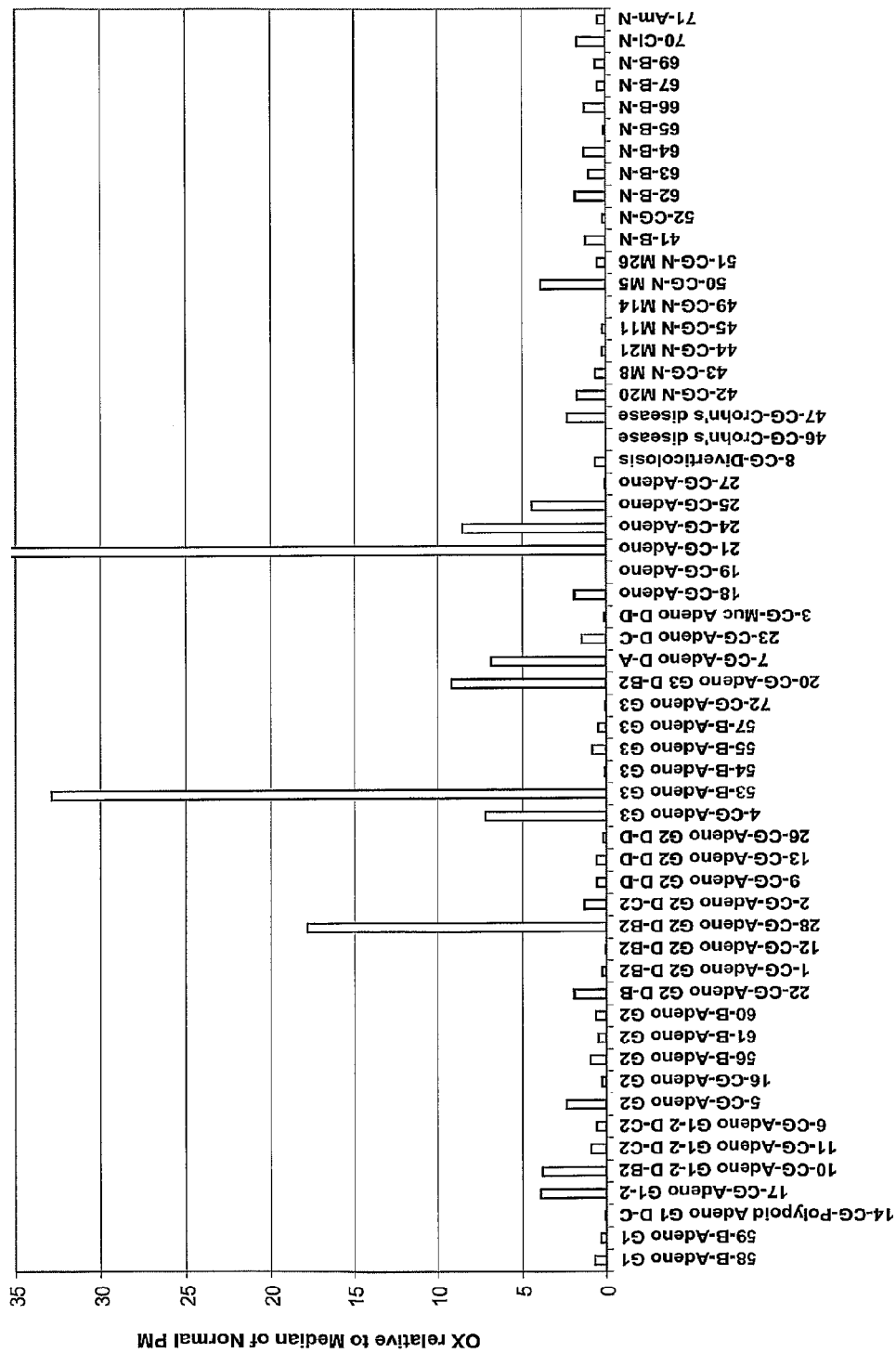
FIG. 68 is a histogram showing over expression of the *Homo sapiens* secretory leukocyte protease inhibitor (antileukoproteinase) Z25299 transcripts which are detectable by amplicon as depicted in sequence name Z25299 seg20 (SEQ ID NO: 452) in cancerous Colon tissues relative to the normal samples.

FIG. 68 is a histogram showing over expression of the above-indicated *Homo sapiens* secretory leukocyte protease inhibitor (antileukoproteinase) transcripts in cancerous Colon samples relative to the normal samples.

As is evident from FIG. 68, the expression of *Homo sapiens* secretory leukocyte protease inhibitor (antileukoproteinase) transcripts detectable by the above amplicon was higher in several cancer samples than in the non-cancerous samples (sample numbers 41, 52, 62, 63, 64, 65, 66, 67, 69, 70 and 71, Table 2 above). Notably an over-expression of at least 5 fold was found in 7 out of 36 adenocarcinoma samples.

Primer pairs are also optionally and preferably encompassed within the present invention; for example, for the above experiment, the following primer pair was used as a non-limiting illustrative example only of a suitable primer pair: Z25299_seg20F (SEQ ID NO: 453) forward primer; and Z25299_seg20R (SEQ ID NO: 454) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg20 (SEQ ID NO: 452).

Forward Primer (Z25299_seg20F
(SEQ ID NO: 453)):
CTCCTGAACCCTACTCCAAGCA

Reverse Primer (Z25299_seg20R
(SEQ ID NO: 454)):
CAGGCGATCCTATGGAAATCC

Amplicon (Z25299_seg20 (SEQ ID NO: 452)):
CTCCTGAACCCTACTCCAAGCACAGCCTCTGTCTGACTCCCTTGTCCTTC
AAGAGAACTGTTCTCCAGGTCTCAGGGCCAGGATTTCCATAGGATCGCCT
G Expression of *Homo sapiens* Secretory Leukocyte Protease Inhibitor (Antileukoproteinase) Z25299 Transcripts which are Detectable by Amplicon as Depicted in Sequence Name Z25299_seg20 (SEQ ID NO: 452) in Normal and Cancerous Breast Tissues Expression of *Homo sapiens* secretory leukocyte protease inhibitor (antileukoproteinase) transcripts detectable by or according to seg20—Z25299_seg20 (SEQ ID NO: 452) amplicon and primers Z25299_seg20F (SEQ ID NO: 453) and Z25299_seg20R (SEQ ID NO: 454) was measured by real time PCR. In parallel the expression of four housekeeping genes—G6PD (GenBank Accession No. NM_000402 (SEQ ID NO:405); G6PD (SEQ ID NO:404) amplicon), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 57, 59, 60, 63, 66, 64, 56, 65, 67 and 58, Table 4 above), to obtain a value of expression for each sample relative to median of the normal PM samples. Then the reciprocal of this ratio was calculated, to obtain a value of fold down-regulation for each sample relative to median of the normal PM samples FIG. 69 is a histogram showing down regulation of the above-indicated *Homo sapiens* secretory leukocyte protease inhibitor (antileukoproteinase) transcripts in cancerous breast samples relative to the normal samples.

Figure 69:
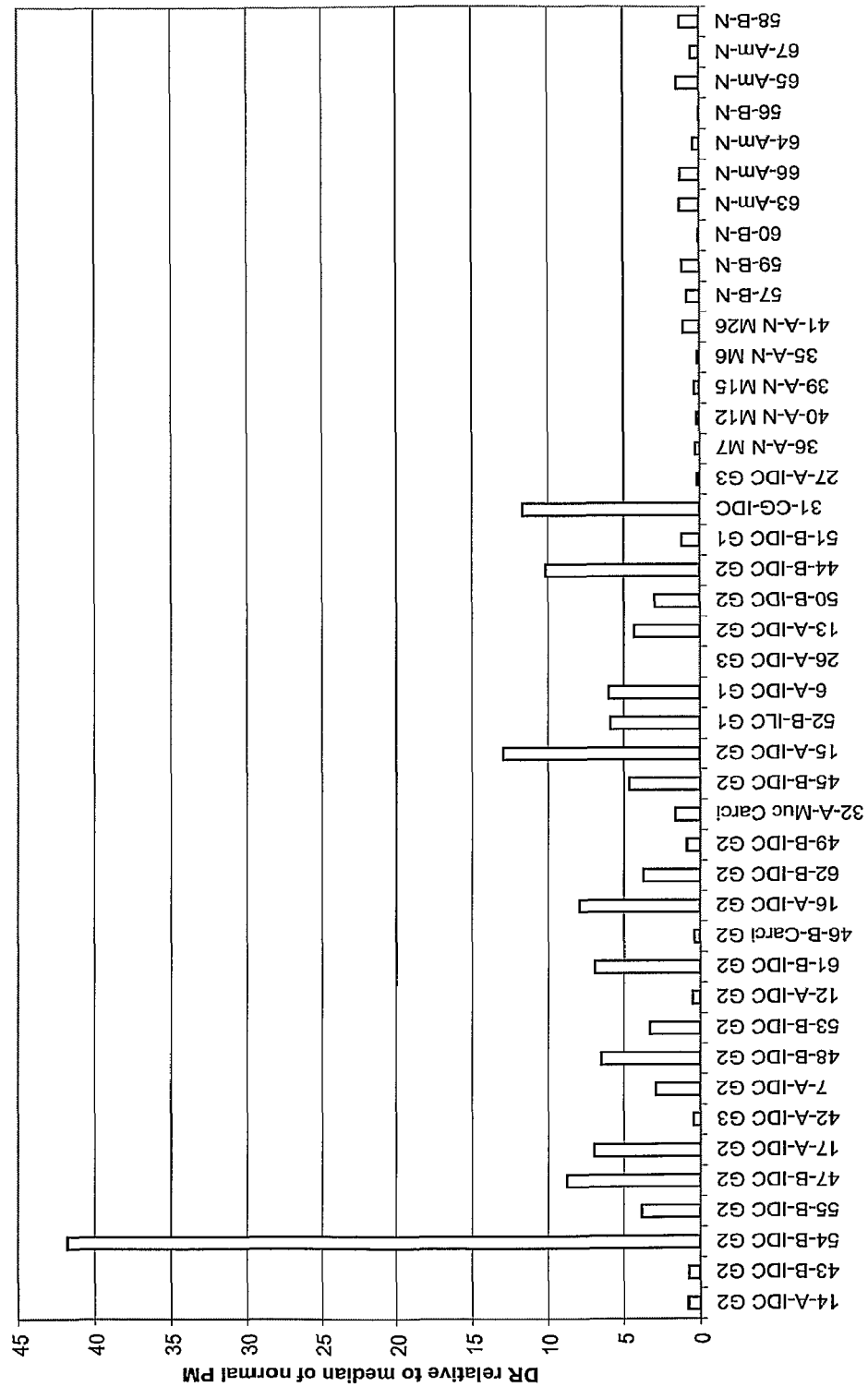
FIG. 69 is a histogram showing down regulation of the *Homo sapiens* secretory leukocyte protease inhibitor (antileukoproteinase) Z25299 transcripts which are detectable by amplicon as depicted in sequence name Z25299 seg20 (SEQ ID NO: 452) in cancerous breast tissues relative to the normal samples.

As is evident from FIG. 69, the expression of *Homo sapiens* secretory leukocyte protease inhibitor (antileukoproteinase) transcripts detectable by the above amplicon was lower in the cancer samples than in the in the non-cancerous samples (sample numbers 57, 59, 60, 63, 66, 64, 56, 65, 67 and 58, Table 4 above). Notably down regulation of at least 5 fold was found in 11 out of 28 adenocarcinoma samples.

Statistical analysis was applied to verify the significance of these results, as described below.

The P value for the difference in the expression levels of *Homo sapiens* secretory leukocyte protease inhibitor (antileukoproteinase) transcripts detectable by the above amplicon in breast adenocarcinoma samples versus the normal tissue samples was determined by T test as 3.42e-03.

Threshold of 5 fold over expression was found to differentiate between adenocarcinoma and normal samples with P value of 2.16e-002 as checked by exact Fisher test. Threshold of 5 fold over expression was found to differentiate between adenocarcinoma and normal samples with P value of 1.52e-02 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: Z25299_seg20F (SEQ ID NO: 453) forward primer; and Z25299_seg20R (SEQ ID NO: 454) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg20 (SEQ ID NO: 452).

Forward Primer (Z25299_seg20F (SEQ ID NO: 453)):
CTCCTGAACCCTACTCCAAGCA

Reverse Primer (Z25299_seg20R (SEQ ID NO: 454)):
CAGGCGATCCTATGGAAATCC

Amplicon (Z25299_seg20 (SEQ ID NO: 452)):
CTCCTGAACCCTACTCCAAGCACAGCCTCTGTCTGACTCCCTTGTCCTTC
AAGAGAACTGTTCTCCAGGTCTCAGGGCCAGGATTTCCATAGGATCGCCT
G Expression of *Homo sapiens* Secretory Leukocyte Protease Inhibitor (Antileukoproteinase) Z25299 Transcripts which are Detectable by Amplicon as Depicted in Sequence Name Z25299_seg23 (SEQ ID NO:455) in Normal and Cancerous Breast Tissues Expression of *Homo sapiens* secretory leukocyte protease inhibitor (antileukoproteinase) transcripts detectable by or according to seg23—Z25299_seg23 (SEQ ID NO:455) amplicon and primers Z25299_seg23F (SEQ ID NO:456) and Z25299_seg23R (SEQ ID NO:457) was measured by real time PCR. In parallel the expression of four housekeeping genes—G6PD (GenBank Accession No. NM_000402 (SEQ ID NO:405); G6PD (SEQ ID NO:404) amplicon), HPRT1 (GenBank Accession No. NM_000194 (SEQ ID NO: 379); amplicon—HPRT1-amplicon (SEQ ID NO:380)), PBGD (GenBank Accession No. BC019323 (SEQ ID NO:381); amplicon—PBGD-amplicon (SEQ ID NO:382)) and SDHA (GenBank Accession No. NM_004168 (SEQ ID NO:364); amplicon—SDHA-amplicon (SEQ ID NO:365)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (sample numbers 57, 59, 60, 63, 66, 64, 56, 65, 67 and 58, Table 4 above), to obtain a value of expression for each sample relative to median of the normal PM samples. Then the reciprocal of this ratio was calculated, to obtain a value of fold down-regulation for each sample relative to median of the normal PM samples FIG. 70 is a histogram showing down regulation of the above-indicated *Homo sapiens* secretory leukocyte protease inhibitor (antileukoproteinase) transcripts in cancerous breast samples relative to the normal samples.

Figure 70:
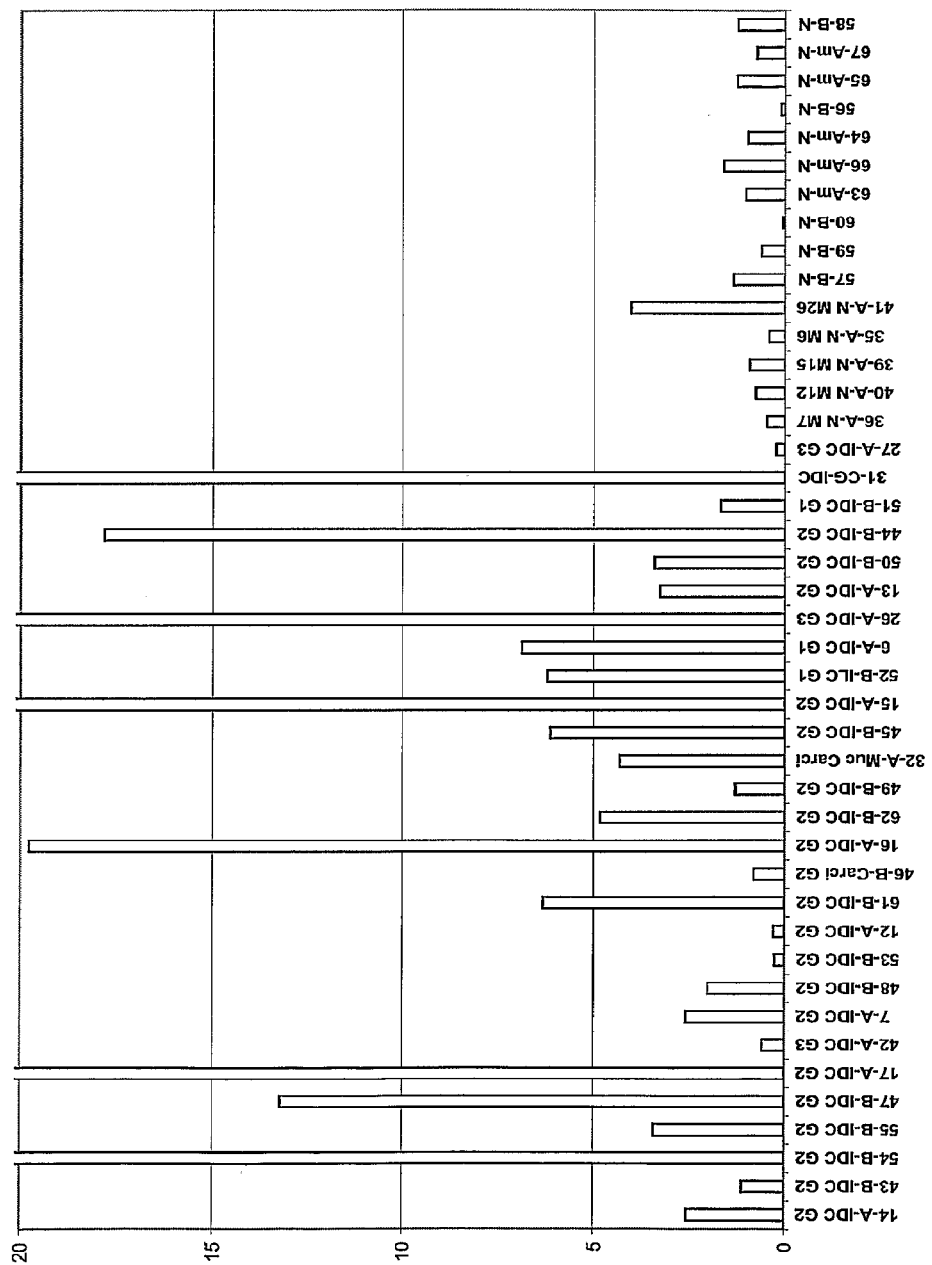
FIG. 70 is a histogram showing down regulation of the *Homo sapiens* secretory leukocyte protease inhibitor (antileukoproteinase) Z25299 transcripts which are detectable by amplicon as depicted in sequence name Z25299 seg23 (SEQ ID NO: 455) in cancerous breast tissues relative to the normal samples.

As is evident from FIG. 70, the expression of *Homo sapiens* secretory leukocyte protease inhibitor (antileukoproteinase) transcripts detectable by the above amplicon was lower in the cancer samples than in the in the non-cancerous samples (sample numbers 57, 59, 60, 63, 66, 64, 56, 65, 67 and 58, Table 4 above). Notably down regulation of at least 5 fold was found in 12 out of 28 adenocarcinoma samples.

Statistical analysis was applied to verify the significance of these results, as described below.

Threshold of 5 fold over expression was found to differentiate between adenocarcinoma and normal samples with P value of 2.16e-002 as checked by exact Fisher test. Threshold of 5 fold over expression was found to differentiate between adenocarcinoma and normal samples with P value of 1.12e-02 as checked by exact Fisher test. This value demonstrates statistical significance of the results.

Primer pairs are also optionally and preferably encompassed within the present invention; for example, for the above experiment, the following primer pair was used as a non-limiting illustrative example only of a suitable primer pair: Z25299_seg23F (SEQ ID NO:456) forward primer; and Z25299_seg23R (SEQ ID NO:457) reverse primer.

The present invention also preferably encompasses any amplicon obtained through the use of any suitable primer pair; for example, for the above experiment, the following amplicon was obtained as a non-limiting illustrative example only of a suitable amplicon: Z25299_seg23 (SEQ ID NO:455).

```
Forward Primer (Z25299_seg23F (SEQ ID NO: 456)):
CAAGCAATTGAGGGACCAGG

Reverse Primer (Z25299_seg23R (SEQ ID NO: 457)):
CAAAAAACATTGTTAATGAGAGAGATGAC

Amplicon (Z25299_seg23 (SEQ ID NO: 455)):
CAAGCAATTGAGGGACCAGGAAGTGGATCCTCTAGAGATGAGGAGGCATT
CTGCTGGATGACTTTTAAAAATGTTTTCTCCAGAGTCATCTCTCTCATTA
ACAATGTTTTTG
```

*Homo sapiens* secretory leukocyte protease inhibitor (anti-leukoproteinase) transcripts detectable by amplicon—Z25299_junc13-14-21 (SEQ ID NO: 444) amplicon and primers Z25299_junc13-14-21-F (SEQ ID NO: 445) and Z25299_junc13-14-21-R (SEQ ID NO: 446) did not show any differential expression in one experiment carried out with each of the following cancer panels: colon cancer and breast cancer.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (592 sequences)

SEQ ID NO: 1 - DNA, 7235 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctaacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 2 - DNA, 7215 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagaattgtcaaactttgagtgccttcatccttgctctcaggaatagaattctacctcatcggatctcatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 3 - DNA, 7447 bp, Homo sapiens
ccttcattcttacacatgcggtggtggccacagctgatgggctacagtctttgactgctttagatcttgtcagctaaatgtaaagttactttgtcaatggaatgctactaacagccgtaatggatagatgagagtaagagaaacacttcggaggaaattttagtgtatttttaagttgtactgaggacgtctgtcagcaatcctttcttttagattcagcacatgcttgttttcacttatttgtaaagtaccatagatttcagtccctgacttaaatttttctgggtttttcctttgcttgcactaaattagaagagaaggttctttttttcccaccgactgcattcctgagtttacaggtagcaccttgatttactgaaacatgaaagcgaatcctttaattgctttcagttcttcataaacaggatgtaattaatttcaaacccaaggaacaccggtaatacattccgatgtaggcatagtccctggaagagaggcactagtggcttctggactagaaatctctgccataggatcacaaatccagatcagcgccttcagcaagcaatagaaataaatgataactggatagagcgagggatgccaggtgtactttttaaaaggcgatagaaaaggtttcgagcttctttgtggctgtttggtatttcctttataatctgttgggggaaggtaatttgatttttttccccctttttcaactgggaataaggaatagtggtagttgggagtctaccaccactgaaattgggctggcaacctggcatcaggggaatttggctgggccactttatggagcaatgaccctttataaataaagtttaatcccaaggcagagtgtttatcttgtagtctttaaatgttacattcttgatgtcagaagaaggcataaggagaaagtcagatcatggattattttcttctgtttggactcaccgtgcttgggaatacttctgagcattagagagcacttcattcattgcagagtctctggcctccgaggctgccttcaccatcagcagcttcagcttctgggagtttcctttccagaggcagagctgatgccttccttgtgacacagcaggatcgtcagaatgacagccccatttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 4 - DNA, 6788 bp, Homo sapiens
gtctctaactgctaacctcaggtgatccgcccacctcggcctcccaaagtactggaattacaggcgtgagccaccacgcccggcctcttaattggtttgtctattgagtgtctgaccagcttattatgaagattcccggaggccaaagagttatgggctccaactgaaagtctgacatgacaagtaggtctatcctgggtagatgccacttgttgccaaggctgatagtaaattatcataattactataatttatcataatgcaaatatcttttgctatatgcaaaaaaactcaagaaccaattataacaaactagagtttttaacctagtttgttataagcaaactacaaagttttactattttcattttagatgaaaaatcatgttttcacaaactgctggtgaaacagtattgccaaccagtgctaataggaccttgttaatgcatgcctcttccttttcagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 5 - DNA, 3903 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccgggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgcattaattgcctactctgagcctgatcctttattatattctagagaaaatgaaaataagcaacacataatcctcacctttgaaaaacaaacataataggtacaaagtcagttcataaatgtgcaatgtgagtggtataaaataacatcagataaaaattagcacttctgatgactaatcaggggagatttcatggaggagatgtcatctgaattggactttgatgaataaaaaagagagttttgatgacgaatattagtttggccaaagtggatgaatataatgttctctaagtcaacaatacagatagtcaactgagcaacaaaacagaagttgctggtcagactagtaggcccatttaggagagcaacaagccacttttgtgtgtgggggggaacaggaggcaaacacatggcctgcatttatgtaatcaaataggtgaattcaaaagctctacagatttatttactcaatggtgaattggattaaaattatattccatgctcttccctgggcaatatggtgctcacacataaaatgccaagattgtccttcaccttaaggtataatgggaagaaataaagctatctacagagtcccttgaaaattacacctttaaaattgacagttggacatcttgaaaatttagaccacatcccatgaataaattaggccatcatggtcaaaaacttatccacatcctccattagcaaccaacataataagtaattcaaatcctcacactgagtttcatcgtcagatactttagaggacaccacacgtttctacaaaaacagcccagtgtaaagttttacttgtccttttggggctaatgctttagcaaacgcataaaaccaccagagtttgcattctaagctccaggaactgaggctttttgaaccttaaga

SEQ ID NO: 6 - DNA, 2623 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcaga

SEQ ID NO: 7 - DNA, 2709 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggtaagagacttttttttcttccatttattatttctcatctttcatcagcccccctttcccttaacagtcccgtcacctgcttccagtatgtatagacctacttgctgatagagccccaaacactgggatctggttcatgctgatagcaatgtccagtgaggaatatttgggccagttcctatgcagaccatattcctaacccatagaaagatcctgcagaatctattcagctggaagtctttaaatagtgcattcagaaagaaatgagaagagccatgt

SEQ ID NO: 8 - DNA, 2819 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagtatttggatataaggactgaggaacagattttttcctttattcagaagactcagacattgaaactcactgtctcatgcaaagctgccttctagtccagccagactacactgatctacaatttgcacctgagctcctttctctggccctataaagtttaaattttaattgtcaaataattttatttttaatgagaaaatgtttgaatttataatttaaaaatatatcccctgaaagagaagtactctagaaatgagataaattttaataaaactgatcataggatatgtttcaccttatttttaacttttcttctttagtgataaccattgtatttatcaaatatattttcaaaccacataacaacagttgaagagcagcttgcagcttatgtaaaatgtcatcagagaagccaactagtatttctgtaaatagtagtagtatttaatttatgttacccatctctgcggattaaaggaagtattctcaaggaaaaattcaattaaaggtgtagacagaattttgccaatagatctgtgttattcaacttaaagagtctcaaggcgagaagcaatctggtgtagagattaggagcataggcacggaggcagacacacctgagcataaattctgcccaggcctgtctgtggtcctttgcatctttgggtgaatcatctaatctctcggaacctcagttgtcctacctgtagaatagggtaatatacccatctcacagggttttggggaggattaaatgagacaattcctgtaaagtgccttgcatgctgcctggtgcattgtaaggcatacataaaggttcgcagaaacaaagaaataatgtaaactcccatcaacgttgttttctgcttctattttaatagaagctttggagacatgatttctggggcaggcttgactacgagtaatgtgtcttgtttggaaggtgtcattcacac

SEQ ID NO: 9 - DNA, 1731 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatggtaagcatagttcagcgttgccaactcatgctatgctttctaatcattgtagatgtctgtgttctctaaataagtcagttttctgttggccaagagttacattatcatgaatgaatacagcttggccatggttccctcctccccctgtcaaaaagcaaaccacattaagtactctttacatttaatacttttgaattgaacagagagtcctttctttagatgcttattatggctaataattcggttagaacctaatatatttatgaaattcttagtgttctgtataaacaaaacagaaaaagatgatgagttttatctttattatctaagaaaaatttctcaggtactaccatgaattagagaaataaaaatatggtatgctaaatcatttagaattaatgctattttattcctgcttttactctcaag

SEQ ID NO: 10 - DNA, 4262 bp, Homo sapiens
ttgtgggctgcatgcccagcccaggcatgcagtggaaacgcagggcaggagagaggaggccttcagagtgcagctggacttccttcccaaccctcttgcttccttcagaccggggtcgggttggcaaaccaagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 11 - DNA, 956 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaaggtaaatttgaacaccgctattctcagcatactttcactgcaaataagcataatgaagttttactcgttctatctttctggaataatttccttacaaacacctgggcttctcagtggactttcctgtaac

SEQ ID NO: 12 - DNA, 3916 bp, Homo sapiens
attacaaacagttacggttctaatgctttccagattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 13 - DNA, 1157 bp, Homo sapiens
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtggtaagacttccattttctacattctgtttgcttttgctttgcaaatgagtcataaatctaccctgatccattggaaaggttgctttcctagtgagtatgaaagaaacgggttaggaaagagattccatcctagttgtagacactttcgtggatgtcaattttaaccagaattgtcaaggcccagttagtcactatgtgctccacaaagagagagactggtctgtataggtcacctctgtacccacagctcctagcacagtatgtggcccatagttggatgaataagtgaataaaaggattttagttctatttcttagttattgagaagcccaaaatagaatacatgatttttgtcatttaacacagctgcattctcttatatgttggaactgtaaaatactgttgtttctactaaattaataaacgcaatgttgctgttatctcgagtgttatat

SEQ ID NO: 14 - DNA, 4132 bp, Homo sapiens
tgatcagctacacacaggaaccttgctcacagccccggaaactccacactgtgggcttcaccttctggaagtgacaaagtcatgtacgcaggaccttccccaccagtctccactgctgagcccataaagggaggtgtgaggacttggaaatgccacatgctttttaagaagccagctcaaaccaacctttgttacaactcgagaatgaaataagtactacaaactattcagccattgatatttatggctgtatgactttttttttttttaactttaaggacatcgtcctacttctgtaagtgtggggaggagtactccacttcacattgaactgcagtgagcggtggggtttcctttccgaattgctgtgtttcattcacagaactcagaccttccatctgcagaggccacaggcacaacaaagaacctgggtatccatgagctctggtgggttggttagtctgccttggtagacgtgttttccactgaccacaggacctggcccagacagccttttaagtgctggtgctataaacccaaacctaaaaatgaagcagggtcacatagtacagaaagcttgggctttatgcggatgatgacagccctccctttgtagtacgtaaggcaatgcataggatgatcactgctctccaactatttctgttgctgttttccccaccagctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 15 - DNA, 3443 bp, Homo sapiens
tgtaatcacacacacacacaaaatacaagcctggcgctagcactcgattatgccattaaataatatttagccgtgtagccatgccaggtcactttgccacctcacatccttttcagagcacctgataaagtcataccacttccctgcacatcatttctctcctgtgccattgggcactcagacgagatgatgcctccagtctctcctatgtctggcattctctgatttcacaacggaccagaatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 16 - protein, 1171 aa, Homo sapiens
MTAPFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 17 - protein, 1173 aa, Homo sapiens
MPLPFQFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 18 - protein, 733 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 19 - protein, 718 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGSANTAVNKKTEI

SEQ ID NO: 20 - protein, 736 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGKRLFFLPFIISHLSSAPLSLNSPVTCFQYV

SEQ ID NO: 21 - protein, 547 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKYLDIRTEEQIFSFIQKTQTLKLTVSCKAAF

SEQ ID NO: 22 - protein, 365 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYGKHSSALPTHAMLSNHCRCLCSLNKSVFCWPRVTLS

SEQ ID NO: 23 - protein, 433 aa, Homo sapiens
MVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 24 - protein, 214 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKVNLNTAILSILSLQISIMKFYSFYLSGIISLQTPGLLSGLSCN

SEQ ID NO: 25 - protein, 343 aa, Homo sapiens
MEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 26 - protein, 183 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISGKTSIFYILFAFALQMSHKSTLIHWKGCFPSEYERNGLGKRFHPSCRHFRGCQF

SEQ ID NO: 27 - protein, 206 aa, Homo sapiens
MLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 28 - protein, 119 aa, Homo sapiens [sequence omitted]

SEQ ID NO: 29 - protein, 480 aa, Homo sapiens
LWAACPAQACSGNAGQERGGLQSAAGLPSQPSCFLQTGVGLANQGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 30 - protein, 541 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPANSSFMLPPTSFSSNYFHFLP

SEQ ID NO: 31 - protein, 567 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITELSNFECLHPCSQE

SEQ ID NO: 32 - DNA, 378 bp, Artificial Sequence
  Synthetic oligonucleotide
taaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacag

SEQ ID NO: 33 - DNA, 227 bp, Artificial Sequence
  Synthetic oligonucleotide
gggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtg

SEQ ID NO: 34 - DNA, 455 bp, Artificial Sequence
  Synthetic oligonucleotide
gtaagacttccattttctacattctgtttgcttttgctttgcaaatgagtcataaatctaccctgatccattggaaaggttgctttcctagtgagtatgaaagaaacgggttaggaaagagattccatcctagttgtagacactttcgtggatgtcaattttaaccagaattgtcaaggcccagttagtcactatgtgctccacaaagagagagactggtctgtataggtcacctctgtacccacagctcctagcacagtatgtggcccatagttggatgaataagtgaataaaaggattttagttctatttcttagttattgagaagcccaaaatagaatacatgatttttgtcatttaacacagctgcattctcttatatgttggaactgtaaaatactgttgtttctactaaattaataaacgcaatgttgctgttatctcgagtgttatat

SEQ ID NO: 35 - DNA, 125 bp, Artificial Sequence
  Synthetic oligonucleotide
atacaggtagacctttcgtagagatgtacagtgaaatccccgaaattatacacatgactgaaggaagggagctcgtcattccctgccgggttacgtcacctaacatcactgttactttaaaaaag

SEQ ID NO: 36 - DNA, 129 bp, Artificial Sequence
  Synthetic oligonucleotide
gtaaatttgaacaccgctattctcagcatactttcactgcaaataagcataatgaagttttactcgttctatctttctggaataatttccttacaaacacctgggcttctcagtggactttcctgtaac

SEQ ID NO: 37 - DNA, 1124 bp, Artificial Sequence
  Synthetic oligonucleotide
ccttcattcttacacatgcggtggtggccacagctgatgggctacagtctttgactgctttagatcttgtcagctaaatgtaaagttactttgtcaatggaatgctactaacagccgtaatggatagatgagagtaagagaaacacttcggaggaaattttagtgtatttttaagttgtactgaggacgtctgtcagcaatcctttcttttagattcagcacatgcttgttttcacttatttgtaaagtaccatagatttcagtccctgacttaaatttttctgggtttttcctttgcttgcactaaattagaagagaaggttctttttttcccaccgactgcattcctgagtttacaggtagcaccttgatttactgaaacatgaaagcgaatcctttaattgctttcagttcttcataaacaggatgtaattaatttcaaacccaaggaacaccggtaatacattccgatgtaggcatagtccctggaagagaggcactagtggcttctggactagaaatctctgccataggatcacaaatccagatcagcgccttcagcaagcaatagaaataaatgataactggatagagcgagggatgccaggtgtactttttaaaaggcgatagaaaaggtttcgagcttctttgtggctgtttggtatttcctttataatctgttgggggaaggtaatttgatttttttccccctttttcaactgggaataaggaatagtggtagttgggagtctaccaccactgaaattgggctggcaacctggcatcaggggaatttggctgggccactttatggagcaatgaccctttataaataaagtttaatcccaaggcagagtgtttatcttgtagtctttaaatgttacattcttgatgtcagaagaaggcataaggagaaagtcagatcatggattattttcttctgtttggactcaccgtgcttgggaatacttctgagcattagagagcacttcattcattgcagagtctctggcctccgaggctgccttcaccatcagcagcttcagcttctgggagtttcctttccagaggcagagctgatgccttccttgtgacacagcaggatcgtcagaatgacagcccca

SEQ ID NO: 38 - DNA, 465 bp, Artificial Sequence
  Synthetic oligonucleotide
gtctctaactgctaacctcaggtgatccgcccacctcggcctcccaaagtactggaattacaggcgtgagccaccacgcccggcctcttaattggtttgtctattgagtgtctgaccagcttattatgaagattcccggaggccaaagagttatgggctccaactgaaagtctgacatgacaagtaggtctatcctgggtagatgccacttgttgccaaggctgatagtaaattatcataattactataatttatcataatgcaaatatcttttgctatatgcaaaaaaactcaagaaccaattataacaaactagagtttttaacctagtttgttataagcaaactacaaagttttactattttcattttagatgaaaaatcatgttttcacaaactgctggtgaaacagtattgccaaccagtgctaataggaccttgttaatgcatgcctcttccttttcag

SEQ ID NO: 39 - DNA, 163 bp, Artificial Sequence
  Synthetic oligonucleotide
tttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaa

SEQ ID NO: 40 - DNA, 137 bp, Artificial Sequence
  Synthetic oligonucleotide
ccaatacaatcatagatgtccaaataagcacaccacgcccagtcaaattacttagaggccatactcttgtcctcaattgtactgctaccactcccttgaacacgagagttcaaatgacctggagttaccctgatgaa

SEQ ID NO: 41 - DNA, 175 bp, Artificial Sequence
  Synthetic oligonucleotide
aaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatg

SEQ ID NO: 42 - DNA, 429 bp, Artificial Sequence
  Synthetic oligonucleotide
gtaagcatagttcagcgttgccaactcatgctatgctttctaatcattgtagatgtctgtgttctctaaataagtcagttttctgttggccaagagttacattatcatgaatgaatacagcttggccatggttccctcctccccctgtcaaaaagcaaaccacattaagtactctttacatttaatacttttgaattgaacagagagtcctttctttagatgcttattatggctaataattcggttagaacctaatatatttatgaaattcttagtgttctgtataaacaaaacagaaaaagatgatgagttttatctttattatctaagaaaaatttctcaggtactaccatgaattagagaaataaaaatatggtatgctaaatcatttagaattaatgctattttattcctgcttttactctcaag

SEQ ID NO: 43 - DNA, 170 bp, Artificial Sequence
  Synthetic oligonucleotide
gttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatg

SEQ ID NO: 44 - DNA, 160 bp, Artificial Sequence
  Synthetic oligonucleotide
tgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaag

SEQ ID NO: 45 - DNA, 954 bp, Artificial Sequence
  Synthetic oligonucleotide
tatttggatataaggactgaggaacagattttttcctttattcagaagactcagacattgaaactcactgtctcatgcaaagctgccttctagtccagccagactacactgatctacaatttgcacctgagctcctttctctggccctataaagtttaaattttaattgtcaaataattttatttttaatgagaaaatgtttgaatttataatttaaaaatatatcccctgaaagagaagtactctagaaatgagataaattttaataaaactgatcataggatatgtttcaccttatttttaacttttcttctttagtgataaccattgtatttatcaaatatattttcaaaccacataacaacagttgaagagcagcttgcagcttatgtaaaatgtcatcagagaagccaactagtatttctgtaaatagtagtagtatttaatttatgttacccatctctgcggattaaaggaagtattctcaaggaaaaattcaattaaaggtgtagacagaattttgccaatagatctgtgttattcaacttaaagagtctcaaggcgagaagcaatctggtgtagagattaggagcataggcacggaggcagacacacctgagcataaattctgcccaggcctgtctgtggtcctttgcatctttgggtgaatcatctaatctctcggaacctcagttgtcctacctgtagaatagggtaatatacccatctcacagggttttggggaggattaaatgagacaattcctgtaaagtgccttgcatgctgcctggtgcattgtaaggcatacataaaggttcgcagaaacaaagaaataatgtaaactcccatcaacgttgttttctgcttctattttaatagaagctttggagacatgatttctggggcaggcttgactacgagtaatgtgtcttgtttggaaggtgtcattcacac

SEQ ID NO: 46 - DNA, 309 bp, Artificial Sequence
  Synthetic oligonucleotide
atgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagag

SEQ ID NO: 47 - DNA, 147 bp, Artificial Sequence
  Synthetic oligonucleotide
atcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctg

SEQ ID NO: 48 - DNA, 279 bp, Artificial Sequence
  Synthetic oligonucleotide
gtaagagacttttttttcttccatttattatttctcatctttcatcagcccccctttcccttaacagtcccgtcacctgcttccagtatgtatagacctacttgctgatagagccccaaacactgggatctggttcatgctgatagcaatgtccagtgaggaatatttgggccagttcctatgcagaccatattcctaacccatagaaagatcctgcagaatctattcagctggaagtctttaaatagtgcattcagaaagaaatgagaagagccatgt

SEQ ID NO: 49 - DNA, 615 bp, Artificial Sequence
  Synthetic oligonucleotide
gctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcagaaaaattctatggctcaatcatggtatcaaaatatctttaatacattggatagctgaaaagatacaccctttgtgctttaattttcctatgttcatgctgtgcatacaataagttctcaattgttgttagctgtatatacagaaaggaggaagagataaggggaaattagtaggggctccaaattagaactgagtaaagaagcaactgggaactcttagaagggactgatgtggtgcaaagtgttgaaagatgaaggtaatttaagacctatttactttgaagaggcaggtgaaaagagagtagacaagctgaagtgaatataatacagagagccagagataagagaggaaaatgcagtgtgaagggactaataccaagaagcaccacacaagagttcaaagtcagagatgaatcctgtttga

SEQ ID NO: 50 - DNA, 1473 bp, Artificial Sequence
  Synthetic oligonucleotide
aactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccgggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgcattaattgcctactctgagcctgatcctttattatattctagagaaaatgaaaataagcaacacataatcctcacctttgaaaaacaaacataataggtacaaagtcagttcataaatgtgcaatgtgagtggtataaaataacatcagataaaaattagcacttctgatgactaatcaggggagatttcatggaggagatgtcatctgaattggactttgatgaataaaaaagagagttttgatgacgaatattagtttggccaaagtggatgaatataatgttctctaagtcaacaatacagatagtcaactgagcaacaaaacagaagttgctggtcagactagtaggcccatttaggagagcaacaagccacttttgtgtgtgggggggaacaggaggcaaacacatggcctgcatttatgtaatcaaataggtgaattcaaaagctctacagatttatttactcaatggtgaattggattaaaattatattccatgctcttccctgggcaatatggtgctcacacataaaatgccaagattgtccttcaccttaaggtataatgggaagaaataaagctatctacagagtcccttgaaaattacacctttaaaattgacagttggacatcttgaaaatttagaccacatcccatgaataaattaggccatcatggtcaaaaacttatccacatcctccattagcaaccaacataataagtaattcaaatcctcacactgagtttcatcgtcagatactttagaggacaccacacgtttctacaaaaacagcccagtgtaaagttttacttgtccttttggggctaatgctttagcaaacgcataaaaccaccagagtttgcattctaagctccaggaactgaggctttttgaaccttaaga

SEQ ID NO: 51 - DNA, 132 bp, Artificial Sequence
  Synthetic oligonucleotide
gaattattttaggaccaggaagcagcacgctgtttattgaaagagtcacagaagaggatgaaggtgtctatcactgcaaagccaccaaccagaagggctctgtggaaagttcagcatacctcactgttcaag

SEQ ID NO: 52 - DNA, 133 bp, Artificial Sequence
  Synthetic oligonucleotide
tcttcttctgaaataaagactgactacctatcaattataatggacccagatgaagttcctttggatgagcagtgtgagcggctcccttatgatgccagcaagtgggagtttgcccgggagagacttaaactgg

SEQ ID NO: 53 - DNA, 133 bp, Artificial Sequence
  Synthetic oligonucleotide
ttgtgggctgcatgcccagcccaggcatgcagtggaaacgcagggcaggagagaggaggccttcagagtgcagctggacttccttcccaaccctcttgcttccttcagaccggggtcgggttggcaaaccaag

SEQ ID NO: 54 - DNA, 157 bp, Artificial Sequence
  Synthetic oligonucleotide
gatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggagg

SEQ ID NO: 55 - DNA, 123 bp, Artificial Sequence
  Synthetic oligonucleotide
tgcattcatcgggacctggcagcgagaaacattcttttatctgagaacaacgtggtgaagatttgtgattttggccttgcccgggatatttataagaaccccgattatgtgagaaaaggagat

SEQ ID NO: 56 - DNA, 682 bp, Artificial Sequence
  Synthetic oligonucleotide
tgatcagctacacacaggaaccttgctcacagccccggaaactccacactgtgggcttcaccttctggaagtgacaaagtcatgtacgcaggaccttccccaccagtctccactgctgagcccataaagggaggtgtgaggacttggaaatgccacatgctttttaagaagccagctcaaaccaacctttgttacaactcgagaatgaaataagtactacaaactattcagccattgatatttatggctgtatgactttttttttttttaactttaaggacatcgtcctacttctgtaagtgtggggaggagtactccacttcacattgaactgcagtgagcggtggggtttcctttccgaattgctgtgtttcattcacagaactcagaccttccatctgcagaggccacaggcacaacaaagaacctgggtatccatgagctctggtgggttggttagtctgccttggtagacgtgttttccactgaccacaggacctggcccagacagccttttaagtgctggtgctataaacccaaacctaaaaatgaagcagggtcacatagtacagaaagcttgggctttatgcggatgatgacagccctccctttgtagtacgtaaggcaatgcataggatgatcactgctctccaactatttctgttgctgttttccccaccag

SEQ ID NO: 57 - DNA, 242 bp, Artificial Sequence
  Synthetic oligonucleotide
tgtaatcacacacacacacaaaatacaagcctggcgctagcactcgattatgccattaaataatatttagccgtgtagccatgccaggtcactttgccacctcacatccttttcagagcacctgataaagtcataccacttccctgcacatcatttctctcctgtgccattgggcactcagacgagatgatgcctccagtctctcctatgtctggcattctctgatttcacaacggaccaga

SEQ ID NO: 58 - DNA, 1005 bp, Artificial Sequence
  Synthetic oligonucleotide
gtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacag

SEQ ID NO: 59 - DNA, 168 bp, Artificial Sequence
  Synthetic oligonucleotide
gtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcata

SEQ ID NO: 60 - DNA, 286 bp, Artificial Sequence
  Synthetic oligonucleotide
tgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaaca

SEQ ID NO: 61 - DNA, 2015 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctata

SEQ ID NO: 62 - DNA, 3161 bp, Homo sapiens
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctgtttagctgcagaccaggaagatgagacctctctgcccttctgacctcgggattttagttttgtggggaccaggggagatagaaaaatacccagggtctcttcattattgctgcctcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctata

SEQ ID NO: 63 - DNA, 3436 bp, Homo sapiens
gcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctgtttagctgcagaccaggaagatgagacctctctgcccttctgacctcgggattttagttttgtggggaccaggggagatagaaaaatacccagggtctcttcattattgctgcctcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctata

SEQ ID NO: 64 - DNA, 2051 bp, Homo sapiens
gcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctata

SEQ ID NO: 65 - protein, 64 aa, Homo sapiens
MQAFRIWDVNQKTFYLRNNQLVAGYLQGPNVNLEGEWLPGKPMYVGITSLCPSVCSSMACLHKP

SEQ ID NO: 66 - protein, 98 aa, Homo sapiens
MEICRGLRSHLITLLLFLFHSETICRPSGRKSSKMQAFRIWDVNQKTFYLRNNQLVAGYLQGPNVNLEGEWLPGKPMYVGITSLCPSVCSSMACLHKP

SEQ ID NO: 67 - protein, 80 aa, Homo sapiens
MALETICRPSGRKSSKMQAFRIWDVNQKTFYLRNNQLVAGYLQGPNVNLEGEWLPGKPMYVGITSLCPSVCSSMACLHKP

SEQ ID NO: 68 - protein, 27 aa, Homo sapiens
MALADLYEEGGGGGGEGEDNADSKGGL

SEQ ID NO: 69 - protein, 74 aa, Homo sapiens
MEICRGLRSHLITLLLFLFHSETICRPSGRKSSKMQAFRIWDVNQKTFYLRNNQLVAGYLQGPNVNLEDRCGTH

SEQ ID NO: 70 - protein, 40 aa, Homo sapiens
MQAFRIWDVNQKTFYLRNNQLVAGYLQGPNVNLEDRCGTH

SEQ ID NO: 71 - DNA, 164 bp, Artificial Sequence
  Synthetic oligonucleotide
tgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttag

SEQ ID NO: 72 - DNA, 63 bp, Artificial Sequence
  Synthetic oligonucleotide
ctgacttgtatgaagaaggaggtggaggaggaggagaaggtgaagacaatgctgactcaaagg

SEQ ID NO: 73 - DNA, 171 bp, Artificial Sequence
  Synthetic oligonucleotide
ggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcaca

SEQ ID NO: 74 - DNA, 301 bp, Artificial Sequence
  Synthetic oligonucleotide
gcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgg

SEQ ID NO: 75 - DNA, 138 bp, Artificial Sequence
  Synthetic oligonucleotide
gtgagtgactatttctttataaaccacaactctgggcccgcaatggcagtccactgccttgctgcagtcacagaatggaaatctgcagaggcctccgcagtcacctaatcactctcctcctcttcctgttccattcag

SEQ ID NO: 76 - DNA, 52 bp, Artificial Sequence
  Synthetic oligonucleotide
agacgatctgccgaccctctgggagaaaatccagcaagatgcaagccttcag

SEQ ID NO: 77 - DNA, 89 bp, Artificial Sequence
  Synthetic oligonucleotide
aatctgggatgttaaccagaagaccttctatctgaggaacaaccaactagttgctggatacttgcaaggaccaaatgtcaatttagaag

SEQ ID NO: 78 - DNA, 898 bp, Artificial Sequence
  Synthetic oligonucleotide
gtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcac

SEQ ID NO: 79 - DNA, 86 bp, Artificial Sequence
  Synthetic oligonucleotide
atggaacaacatccaggagactcaggcctctaggagtaactgggtagtgtgcatcctggggaaagtgagggaaatatggacatcac

SEQ ID NO: 80 - DNA, 86 bp, Artificial Sequence; identical to SEQ ID NO: 79
  Synthetic oligonucleotide

SEQ ID NO: 81 - DNA, 86 bp, Artificial Sequence; identical to SEQ ID NO: 79
  Synthetic oligonucleotide

SEQ ID NO: 82 - DNA, 224 bp, Artificial Sequence
  Synthetic oligonucleotide
atggaacaacatccaggagactcaggcctctaggagtaactgggtagtgtgcttggtttaatcttctgtttagctgcagaccaggaagatgagacctctctgcccttctgacctcgggattttagttttgtggggaccaggggagatagaaaaatacccagggtctcttcattattgctgcctcctcttctattaacctgaccctcccctctgttcttccccag

SEQ ID NO: 83 - DNA, 5 bp, Artificial Sequence
  Synthetic oligonucleotide
aaaag

SEQ ID NO: 84 - DNA, 102 bp, Artificial Sequence
  Synthetic oligonucleotide
atagatgtggtacccattgagcctcatgctctgttcttgggaatccatggagggaagatgtgcctgtcctgtgtcaagtctggtgatgagaccagactccag

SEQ ID NO: 85 - DNA, 6 bp, Artificial Sequence
  Synthetic oligonucleotide
ctggag

SEQ ID NO: 86 - DNA, 4 bp, Artificial Sequence
  Synthetic oligonucleotide
gcag

SEQ ID NO: 87 - DNA, 76 bp, Artificial Sequence
  Synthetic oligonucleotide
ttaacatcactgacctgagcgagaacagaaagcaggacaagcgcttcgccttcatccgctcagacagtggccccac

SEQ ID NO: 88 - DNA, 78 bp, Artificial Sequence
  Synthetic oligonucleotide
caccagttttgagtctgccgcctgccccggttggttcctctgcacagcgatggaagctgaccagcccgtcagcctcac

SEQ ID NO: 89 - DNA, 248 bp, Artificial Sequence
  Synthetic oligonucleotide
caatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgc

SEQ ID NO: 90 - DNA, 399 bp, Artificial Sequence
  Synthetic oligonucleotide
ctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaa

SEQ ID NO: 91 - DNA, 142 bp, Artificial Sequence
  Synthetic oligonucleotide
gtaagtggtagcttttcccttctttttcttctttttttgtgatgtcccaacttgtaaaaattaaaagttatggtactatgttagccccataattttttttttccttttaaaacacttccataatctggactcctctgtccag

SEQ ID NO: 92 - DNA, 139 bp, Artificial Sequence
  Synthetic oligonucleotide
gcactgctgcccagcctccaagctccatctccactccagattttttacagctgcctgcagtactttacctcctatcagaagtttctcagctcccaaggctctgagcaaatgtggctcctgggggttctttcttcctctg

SEQ ID NO: 93 - DNA, 79 bp, Artificial Sequence
  Synthetic oligonucleotide
ctgaaggaataaattgctccttgacattgtagagcttctggcacttggagacttgtatgaaagatggctgtgcctctgc

SEQ ID NO: 94 - DNA, 29 bp, Artificial Sequence
  Synthetic oligonucleotide
ctgtctcccccaccgggctgggagctctg

SEQ ID NO: 95 - DNA, 169 bp, Artificial Sequence
  Synthetic oligonucleotide
cagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctata

SEQ ID NO: 96 - DNA, 1943 bp, Homo sapiens
cctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaagccaccttgtcctgacgcttggcttattgcaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctg

SEQ ID NO: 97 - DNA, 2215 bp, Homo sapiens
ctggagccctggtggctttgctaaaagcatctgtccactaatcccaggcgggtccctggccttgtggtcagggtcgaggccccatggccaaccaggcgtccccaggacctctgacctggcctggtgggggtggcggaggagccagctgaagaagctgttggtggggaggctggccctgcccccaccagggctcaggactgagccgtgggctcctgggtgggctggggacgagacaaggggtctcgctgtgccttttctcctgggtgggtggccggaggtcctgagtgcagggcctggggaagtgagcagggcccttttcccaggagccgggtgagtctggctgggagccagcttgggcagtgaaatcctgacaaagccaatgaactgccttcccactgcgttgtcccactgccctgggagtccccagccccagcccaagagtaggagtgggctgggcagtccctgaggagtccgagcagcccagccacccgcctgcctgctgcagggctggccagaggtgtaacgttaccggctgcaccagctcatggcgccacccgctccagcccctcagctcccaccagctgatcacctccccctgggctctggcacccagccaaggcgggctgtgcagggcccagcagggttggcctgggggctgggtagaaggcagacccgcaggattggaagatctttgggatgcagcaggccaagggtctccaaaagcttctagcctcccatccttttccaaatgaggaaaactgaggccagagaggggtgggacctaacctacccagggtccagtgagtttttagtggtactcaggctgctctgagacagggcagagcatgtgcagcaagtgggaaggaacccagaggggcccctaccttcttgccatcacacttggcccaagagtgcagagctccaaggtacccccagctcacctctgcacttttctgtccatagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctg

SEQ ID NO: 98 - DNA, 2015 bp, Homo sapiens
cctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtaagtggtttggctggggctcggggctattctcgggcctgccagcctctgtcctagcatggggttccccagccaccttgtcctgacgcttggcttattgcaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctg

SEQ ID NO: 99 - protein, 203 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPESHLVLTLGLLQEETQGQGEEEEREAETHRLPPVRRCCSPEVTHPLEERDPAPGSCIYYRHTLQ

SEQ ID NO: 100 - protein, 110 aa, Homo sapiens
WSPGGFAKSICPLIPGGSLALWSGSRPHGQPGVPRTSDLAWWGWRRSQLKKLLVGRLALPPPGLRTEPWAPGWAGDETRGLAVPFLLGGWPEVLSAGPGEVSRALFPGAG

SEQ ID NO: 101 - protein, 141 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPER

SEQ ID NO: 102 - protein, 103 aa, Homo sapiens
MCSKWEGTQRGPYLLAITLGPRVQSSKVPPAHLCTFLSIAVGLVCWERLVRGGSGTLPGSVGPQLLPGAGEAGGRRVRVPQRGGAHVQPILCLPAALHRLLRR

SEQ ID NO: 103 - DNA, 597 bp, Artificial Sequence
  Synthetic oligonucleotide
cctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccag

SEQ ID NO: 104 - DNA, 963 bp, Artificial Sequence
  Synthetic oligonucleotide
ctggagccctggtggctttgctaaaagcatctgtccactaatcccaggcgggtccctggccttgtggtcagggtcgaggccccatggccaaccaggcgtccccaggacctctgacctggcctggtgggggtggcggaggagccagctgaagaagctgttggtggggaggctggccctgcccccaccagggctcaggactgagccgtgggctcctgggtgggctggggacgagacaaggggtctcgctgtgccttttctcctgggtgggtggccggaggtcctgagtgcagggcctggggaagtgagcagggcccttttcccaggagccgggtgagtctggctgggagccagcttgggcagtgaaatcctgacaaagccaatgaactgccttcccactgcgttgtcccactgccctgggagtccccagccccagcccaagagtaggagtgggctgggcagtccctgaggagtccgagcagcccagccacccgcctgcctgctgcagggctggccagaggtgtaacgttaccggctgcaccagctcatggcgccacccgctccagcccctcagctcccaccagctgatcacctccccctgggctctggcacccagccaaggcgggctgtgcagggcccagcagggttggcctgggggctgggtagaaggcagacccgcaggattggaagatctttgggatgcagcaggccaagggtctccaaaagcttctagcctcccatccttttccaaatgaggaaaactgaggccagagaggggtgggacctaacctacccagggtccagtgagtttttagtggtactcaggctgctctgagacagggcagagcatgtgcagcaagtgggaaggaacccagaggggcccctaccttcttgccatcacacttggcccaagagtgcagagctccaaggtacccccagctcacctctgcacttttctgtccatag

SEQ ID NO: 105 - DNA, 3 bp, Artificial Sequence
  Synthetic oligonucleotide
cag

SEQ ID NO: 106 - DNA, 40 bp, Artificial Sequence
  Synthetic oligonucleotide
tgggccttgtctgctgggaacggctcgtcagaggtggaag

SEQ ID NO: 107 - DNA, 197 bp, Artificial Sequence
  Synthetic oligonucleotide
tggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcag

SEQ ID NO: 108 - DNA, 77 bp, Artificial Sequence
  Synthetic oligonucleotide
ctcctaaagatccgttctggggaccggccctcctacgtggagctgacgttctctcagcacgttcgctgcgaatgccg

SEQ ID NO: 109 - DNA, 30 bp, Artificial Sequence
  Synthetic oligonucleotide
gcctctgcgggagaagatgaagccggaaag

SEQ ID NO: 110 - DNA, 72 bp, Artificial Sequence
  Synthetic oligonucleotide
gtaagtggtttggctggggctcggggctattctcgggcctgccagcctctgtcctagcatggggttccccag

SEQ ID NO: 111 - DNA, 31 bp, Artificial Sequence
  Synthetic oligonucleotide
ccaccttgtcctgacgcttggcttattgcag

SEQ ID NO: 112 - DNA, 63 bp, Artificial Sequence
  Synthetic oligonucleotide
gaggagacccaagggcagggggaagaggaggagagagaagcagagacccacagactgccacct

SEQ ID NO: 113 - DNA, 905 bp, Artificial Sequence
  Synthetic oligonucleotide
gtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagtcaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctg

SEQ ID NO: 114 - DNA, 3475 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 115 - DNA, 3473 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagtcgggagggagccctagagtgatccagagatgtggagaggccaggaccacacgacaggagagtcctgcaaagggaccctccacagctgtgtgtctccttcctcagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 116 - DNA, 4744 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaaggtgaggcatccagggcctcacagagcccaggagcacacgcatacctgtagctccctgcagctcccacctctctcccaactcacacccccgtcaggacccagctggctgccagaagttaggaggggagagagccgcttgtgcattgcccccacccaggggaccctggggctcaggctcaggcctggtaggtgccaggcctacagttcatgcaacaaacattaagcccccactgtatggaggtgccacgccaggagccaaagtacaaaaacggacaagacgcagctttgtcctccagcagctcaccatctgatggagaaagatccccagaggtctctgtagaaaggttgctttgatctttcaagaggggaatttccacagatagattccccatccttgcctgagtccaacttggagtcttccagacctgcagtggctattgtccaatggccccgccagcccagggctaccttgcccaaattggggcccaaatgaggaaaggccctgccccctcagcctttcccagatagggttgcgtgggccaccaggggcacaaggcagcaggtgaggttcctgctgaggcaggtggttcacttgagcccaggagttcaagaccagcttgggcaacatggcgaaaccccgtctctactaagaatacaaaaattagccagatgtgacaggtgcctgtagtcccagctactcgggaggctgaggcaggagaatcacttgaacccaggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 117 - DNA, 4125 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgtgagggctgcaagctcacctcctgcctgcctccccacgcaggcccctgtgcccacccatggggagccacacacacagcaccccagccagccagacacacacacacacacacacacacacacagcacccaagccggccagacacaaacacacagcaccccagccagccggacacacacacacacacacacacaacaccccagctggccggacacacacacacacagtaccccagctggccggacacacacacacacagcaccctatccagacacatacacacacacagtaccccagccagctggaaacacacacacacacagcactccatccagacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 118 - DNA, 2646 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagtcgggagggagccctagagtgatccagagatgtggagaggccaggaccacacgacaggagagtcctgcaaagggaccctccacagctgtgtgtctccttcctcagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 119 - DNA, 3375 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccagaacctccccattggagctgggagcctcccccactcatgtgtcctccaccttggggcccctccctccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 120 - DNA, 3645 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagtcgggagggagccctagagtgatccagagatgtggagaggccaggaccacacgacaggagagtcctgcaaagggaccctccacagctgtgtgtctccttcctcagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 121 - DNA, 3119 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 122 - DNA, 2394 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 123 - DNA, 3213 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 124 - DNA, 3177 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 125 - DNA, 3226 bp, Homo sapiens
catagaataaagatggatgggatgggatgggatgggatgggatgacacagaataaagatggatggattgggatggatgaatagaagagatggatgggataaattgatatggatgagatgggacaagttgggctggtgggcagctgcatgtgccttggagtgctctgttggcctcttcctaagagaacctccccattggagctgggagcctcccccactcatgtgtcctccaccttggggcccctccctccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 126 - DNA, 4048 bp, Homo sapiens
catagaataaagatggatgggatgggatgggatgggatgggatgacacagaataaagatggatggattgggatggatgaatagaagagatggatgggataaattgatatggatgagatgggacaagttgggctggtgggcagctgcatgtgccttggagtgctctgttggcctcttcctaagagaacctccccattggagctgggagcctcccccactcatgtgtcctccaccttggggcccctccctccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgtgagggctgcaagctcacctcctgcctgcctccccacgcaggcccctgtgcccacccatggggagccacacacacagcaccccagccagccagacacacacacacacacacacacacacacagcacccaagccggccagacacaaacacacagcaccccagccagccggacacacacacacacacacacacaacaccccagctggccggacacacacacacacagtaccccagctggccggacacacacacacacagcaccctatccagacacatacacacacacagtaccccagccagctggaaacacacacacacacagcactccatccagacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacaca

SEQ ID NO: 127 - protein, 319 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPSEPTAPSLAQCLLSSSPYPATA

SEQ ID NO: 128 - protein, 365 aa, Homo sapiens [sequence omitted]

SEQ ID NO: 129 - protein, 344 aa, Homo sapiens
MDEMGQVGLVGSCMCLGVLCWPLPKRTSPLELGASPTHVSSTLGPLPPQDDLCQECEDIVHILNKMAKEAIFQDTMRKFLEQECNVLPLKLLMPQCNQVLDDYFPLVIDYFQNQTVRAASSPPACLPTQAPVPTHGEPHTQHPSQPDTHTHTHTHTAPKPARHKHTAPQPAGHTHTHTHNTPAGRTHTHTVPQLAGHTHTQHPIQTHTHTQYPSQLETHTHTALHPDTYPHSTPASQTHTHTHTHTHTQHTHSTPAGHTHTHTHPVHKGPRKLRALQPCTRPWAPRFRCTRWACTLTHPYTLTLTHMLTHLFILTYMLMLIHTQSRPPALKSPHSPIFAFCPPT

SEQ ID NO: 130 - protein, 307 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPSEPTAPSLAQCLLSSSPYPATA

SEQ ID NO: 131 - protein, 339 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKLAPVC

SEQ ID NO: 132 - protein, 297 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKVRHPGPHRAQEHTHTCSSLQLPPLSQLTPPSGPSWLPEVRRGESRLCIAPTQGTLGLRLRPGRCQAYSSCNKH

SEQ ID NO: 133 - protein, 360 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTVRAASSPPACLPTQAPVPTHGEPHTQHPSQPDTHTHTHTHTAPKPARHKHTAPQPAGHTHTHTHNTPAGRTHTHTVPQLAGHTHTQHPIQTHTHTQYPSQLETHTHTALHPDTYPHSTPASQTHTHTHTHTHTQHTHSTPAGHTHTHTHPVHKGPRKLRALQPCTRPWAPRFRCTRWACTLTHPYTLTLTHMLTHLFILTYMLMLIHTQSRPPALKSPHSPIFAFCPPT

SEQ ID NO: 134 - protein, 405 aa, Homo sapiens
MAESHLLQWLLLLLPTLCGPGTAAWTTSSLACAQGPEFWCQSLEQALQCRALGHCLQEVWGHVGARTSPLELGASPTHVSSTLGPLPPQDDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 135 - protein, 243 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGRRQENGCRETLSATSACP

SEQ ID NO: 136 - protein, 385 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQKKTPSFKVLQYGQTWWLTPAIPAP

SEQ ID NO: 137 - protein, 351 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 138 - protein, 339 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 139 - DNA, 68 bp, Artificial Sequence
  Synthetic oligonucleotide
tgtaaatgctcttctgactaatgcaaaccatgtgtccatagaaccagaagatttttccaggggaaaag

SEQ ID NO: 140 - DNA, 135 bp, Artificial Sequence
  Synthetic oligonucleotide
agcccccacgccccgcccagctataaggggccatgcaccaagcagggtacccaggctgcagaggtgccatggctgagtcacacctgctgcagtggctgctgctgctgctgcccacgctctgtggcccaggcactg

SEQ ID NO: 141 - DNA, 25 bp, Artificial Sequence
  Synthetic oligonucleotide
ctgcctggaccacctcatccttggc

SEQ ID NO: 142 - DNA, 103 bp, Artificial Sequence
  Synthetic oligonucleotide
ctgtgcccagggccctgagttctggtgccaaagcctggagcaagcattgcagtgcagagccctagggcattgcctacaggaagtctggggacatgtgggagcc

SEQ ID NO: 143 - DNA, 182 bp, Artificial Sequence
  Synthetic oligonucleotide
catagaataaagatggatgggatgggatgggatgggatgggatgacacagaataaagatggatggattgggatggatgaatagaagagatggatgggataaattgatatggatgagatgggacaagttgggctggtgggcagctgcatgtgccttggagtgctctgttggcctcttcctaag

SEQ ID NO: 144 - DNA, 72 bp, Artificial Sequence
  Synthetic oligonucleotide
agaacctccccattggagctgggagcctcccccactcatgtgtcctccaccttggggcccctccctccccag

SEQ ID NO: 145 - DNA, 72 bp, Artificial Sequence
  Synthetic oligonucleotide
gatgacctatgccaagagtgtgaggacatcgtccacatccttaacaagatggccaaggaggccattttccag

SEQ ID NO: 146 - DNA, 36 bp, Artificial Sequence
  Synthetic oligonucleotide
gacacgatgaggaagttcctggagcaggagtgcaac

SEQ ID NO: 147 - DNA, 90 bp, Artificial Sequence
  Synthetic oligonucleotide
gtcctccccttgaagctgctcatgccccagtgcaaccaagtgcttgacgactacttccccctggtcatcgactacttccagaaccagact

SEQ ID NO: 148 - DNA, 186 bp, Artificial Sequence
  Synthetic oligonucleotide
gtgagggctgcaagctcacctcctgcctgcctccccacgcaggcccctgtgcccacccatggggagccacacacacagcaccccagccagccagacacacacacacacacacacacacacacagcacccaagccggccagacacaaacacacagcaccccagccagccggacacacacacacacac

SEQ ID NO: 149 - DNA, 64 bp, Artificial Sequence
  Synthetic oligonucleotide
acacacaacaccccagctggccggacacacacacacacagtaccccagctggccggacacacac

SEQ ID NO: 150 - DNA, 572 bp, Artificial Sequence
  Synthetic oligonucleotide
acacacagcaccctatccagacacatacacacacacagtaccccagccagctggaaacacacacacacacagcactccatccagacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccag

SEQ ID NO: 151 - DNA, 24 bp, Artificial Sequence
  Synthetic oligonucleotide
gactcaaacggcatctgtatgcac

SEQ ID NO: 152 - DNA, 50 bp, Artificial Sequence
  Synthetic oligonucleotide
ctgggcctgtgcaaatcccggcagccagagccagagcaggagccagggat

SEQ ID NO: 153 - DNA, 20 bp, Artificial Sequence
  Synthetic oligonucleotide
gtcagaccccctgcccaaac

SEQ ID NO: 154 - DNA, 29 bp, Artificial Sequence
  Synthetic oligonucleotide
ctctgcgggaccctctgccagaccctctg

SEQ ID NO: 155 - DNA, 28 bp, Artificial Sequence
  Synthetic oligonucleotide
ctggacaagctcgtcctccctgtgctgc

SEQ ID NO: 156 - DNA, 38 bp, Artificial Sequence
  Synthetic oligonucleotide
ccggggccctccaggcgaggcctgggcctcacacacag

SEQ ID NO: 157 - DNA, 90 bp, Artificial Sequence
  Synthetic oligonucleotide
gatctctccgagcagcaattccccattcctctcccctattgctggctctgcagggctctgatcaagcggatccaagccatgattcccaag

SEQ ID NO: 158 - DNA, 554 bp, Artificial Sequence
  Synthetic oligonucleotide
gtgaggcatccagggcctcacagagcccaggagcacacgcatacctgtagctccctgcagctcccacctctctcccaactcacacccccgtcaggacccagctggctgccagaagttaggaggggagagagccgcttgtgcattgcccccacccaggggaccctggggctcaggctcaggcctggtaggtgccaggcctacagttcatgcaacaaacattaagcccccactgtatggaggtgccacgccaggagccaaagtacaaaaacggacaagacgcagctttgtcctccagcagctcaccatctgatggagaaagatccccagaggtctctgtagaaaggttgctttgatctttcaagaggggaatttccacagatagattccccatccttgcctgagtccaacttggagtcttccagacctgcagtggctattgtccaatggccccgccagcccagggctaccttgcccaaattggggcccaaatgaggaaaggccctgccccctcagcctttcccagatagggttgcgtgggccaccaggggcacaag

SEQ ID NO: 159 - DNA, 61 bp, Artificial Sequence
  Synthetic oligonucleotide
gcagcaggtgaggttcctgctgaggcaggtggttcacttgagcccaggagttcaagaccag

SEQ ID NO: 160 - DNA, 368 bp, Artificial Sequence
  Synthetic oligonucleotide
cttgggcaacatggcgaaaccccgtctctactaagaatacaaaaattagccagatgtgacaggtgcctgtagtcccagctactcgggaggctgaggcaggagaatcacttgaacccaggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactg

SEQ ID NO: 161 - DNA, 396 bp, Artificial Sequence
  Synthetic oligonucleotide
gccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgg

SEQ ID NO: 162 - DNA, 62 bp, Artificial Sequence
  Synthetic oligonucleotide
gcagagagtggaggcttgccaagtgaaggtcccatgctggcctctctccgcccccgccccag

SEQ ID NO: 163 - DNA, 184 bp, Artificial Sequence
  Synthetic oligonucleotide
ggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaa

SEQ ID NO: 164 - DNA, 172 bp, Artificial Sequence
  Synthetic oligonucleotide
gtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccag

SEQ ID NO: 165 - DNA, 12 bp, Artificial Sequence
  Synthetic oligonucleotide
ggtcgccgacag

SEQ ID NO: 166 - DNA, 32 bp, Artificial Sequence
  Synthetic oligonucleotide
gagaatggctgccgcgagactctgagtgccac

SEQ ID NO: 167 - DNA, 8 bp, Artificial Sequence
  Synthetic oligonucleotide
ctctgcat

SEQ ID NO: 168 - DNA, 44 bp, Artificial Sequence
  Synthetic oligonucleotide
gtccgtgaccacccaggccgggaacagcagcgagcaggccatac

SEQ ID NO: 169 - DNA, 29 bp, Artificial Sequence
  Synthetic oligonucleotide
cacaggcaatgctccaggcctgtgttggc

SEQ ID NO: 170 - DNA, 6 bp, Artificial Sequence
  Synthetic oligonucleotide
tcctgg

SEQ ID NO: 171 - DNA, 15 bp, Artificial Sequence
  Synthetic oligonucleotide
ctggacagggaaaag

SEQ ID NO: 172 - DNA, 170 bp, Artificial Sequence
  Synthetic oligonucleotide
ctggctccagtttgttaagggtttcaactgcagccagaggtgttccgtgagggctgatggaggagtcgggagggagccctagagtgatccagagatgtggagaggccaggaccacacgacaggagagtcctgcaaagggaccctccacagctgtgtgtctccttcctcag

SEQ ID NO: 173 - DNA, 33 bp, Artificial Sequence
  Synthetic oligonucleotide
tgcaagcaatttgtggagcagcacacgccccag

SEQ ID NO: 174 - DNA, 48 bp, Artificial Sequence
  Synthetic oligonucleotide
ctgctgaccctggtgcccaggggctgggatgcccacaccacctgccag

SEQ ID NO: 175 - DNA, 23 bp, Artificial Sequence
  Synthetic oligonucleotide
gccctcggggtgtgtgggaccat

SEQ ID NO: 176 - DNA, 16 bp, Artificial Sequence
  Synthetic oligonucleotide
gtccagccctctccag

SEQ ID NO: 177 - DNA, 43 bp, Artificial Sequence
  Synthetic oligonucleotide
tgtatccacagccccgacctttgatgagaactcagctgtccag

SEQ ID NO: 178 - DNA, 58 bp, Artificial Sequence
  Synthetic oligonucleotide
ctgcaaaggaaaagccaagtgagacgggctctgggaccatggtgaccaggctcttccc

SEQ ID NO: 179 - DNA, 46 bp, Artificial Sequence
  Synthetic oligonucleotide
ctgctccctggccctcgccagctgccaggctgaaaagaagcctcag

SEQ ID NO: 180 - DNA, 68 bp, Artificial Sequence
  Synthetic oligonucleotide
ctcccacaccgccctcctcaccgcccttcctcggcagtcacttccactggtggaccacgggcccccag

SEQ ID NO: 181 - DNA, 37 bp, Artificial Sequence
  Synthetic oligonucleotide
ccctgtgtcggccttgtctgtctcagctcaaccacag

SEQ ID NO: 182 - DNA, 74 bp, Artificial Sequence
  Synthetic oligonucleotide
tctgacaccagagcccacttccatcctctctggtgtgaggcacagcgagggcagcatctggaggagctctgcag

SEQ ID NO: 183 - DNA, 544 bp, Artificial Sequence
  Synthetic oligonucleotide
cctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaag

SEQ ID NO: 184 - DNA, 133 bp, Artificial Sequence
  Synthetic oligonucleotide
aaaaagacaccgtcctttaaagtgctgcagtatggccagacgtggtggctcacacctgcaatcccagcaccttaggaggccgaggcaggaggatccttgaggtcaggagttcgagaccagcctcgccaacatg

SEQ ID NO: 185 - DNA, 173 bp, Artificial Sequence
  Synthetic oligonucleotide
gtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccag

SEQ ID NO: 186 - DNA, 388 bp, Artificial Sequence
  Synthetic oligonucleotide
cctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagaga

SEQ ID NO: 187 - DNA, 112 bp, Artificial Sequence
  Synthetic oligonucleotide
gtggaaattacccactgtcaggcctctgagcccaagctaagccatcatatcccctgtgccctgcacgtatacacccagatggcctgaagcaactgaagatccacaaaagaag

SEQ ID NO: 188 - DNA, 733 bp, Artificial Sequence
  Synthetic oligonucleotide
tgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgaga

SEQ ID NO: 189 - DNA, 1735 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcat

SEQ ID NO: 190 - DNA, 1589 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcat

SEQ ID NO: 191 - DNA, 1818 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcat

SEQ ID NO: 192 - DNA, 1616 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcat

SEQ ID NO: 193 - protein, 139 aa, Homo sapiens
MKLVSVALMYLGSLAFLGADTARLDVASEFRKKWNKWALSRGKRELRMSSSYPTGLADVKAGPAQTLIRPQDMKGASRSPEDSCLSSPSPRPQQSGCRPHPSQALPPEHEQLPGPPELWLPLRDVHGAEAGTPDLPVHR

SEQ ID NO: 194 - protein, 33 aa, Homo sapiens
MKLVSVALMYLGSLAFLGADTARLDVASEFRKK

SEQ ID NO: 195 - protein, 83 aa, Homo sapiens
MKLVSVALMYLGSLAFLGADTARLDVASEFRKKWNKWALSRGKRELRMSSSYPTGLADVKAGPAQTLIRPQDMKGASRSPEDR

SEQ ID NO: 196 - DNA, 245 bp, Artificial Sequence
  Synthetic oligonucleotide
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcag

SEQ ID NO: 197 - DNA, 119 bp, Artificial Sequence
  Synthetic oligonucleotide
ggtctgcgcttcgcagccgggatgaagctggtttccgtcgccctgatgtacctgggttcgctcgccttcctaggcgctgacaccgctcggttggatgtcgcgtcggagtttcgaaagaa

SEQ ID NO: 198 - DNA, 4 bp, Artificial Sequence
  Synthetic oligonucleotide
gtga

SEQ ID NO: 199 - DNA, 146 bp, Artificial Sequence
  Synthetic oligonucleotide
gtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccag

SEQ ID NO: 200 - DNA, 59 bp, Artificial Sequence
  Synthetic oligonucleotide
gtggaataagtgggctctgagtcgtgggaagagggaactgcggatgtccagcagctacc

SEQ ID NO: 201 - DNA, 40 bp, Artificial Sequence
  Synthetic oligonucleotide
ccaccgggctcgctgacgtgaaggccgggcctgcccagac

SEQ ID NO: 202 - DNA, 51 bp, Artificial Sequence
  Synthetic oligonucleotide
ccttattcggccccaggacatgaagggtgcctctcgaagccccgaagacag

SEQ ID NO: 203 - DNA, 202 bp, Artificial Sequence
  Synthetic oligonucleotide
gtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaag

SEQ ID NO: 204 - DNA, 31 bp, Artificial Sequence
  Synthetic oligonucleotide
ttgcctttcttccccctccccccgcccgcag

SEQ ID NO: 205 - DNA, 3 bp, Artificial Sequence
  Synthetic oligonucleotide
cag

SEQ ID NO: 206 - DNA, 81 bp, Artificial Sequence
  Synthetic oligonucleotide
tccggatgccgcccgcatccgagtcaagcgctaccgccagagcatgaacaacttccagggcctccggagctttggctgccg

SEQ ID NO: 207 - DNA, 161 bp, Artificial Sequence
  Synthetic oligonucleotide
cttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgt

SEQ ID NO: 208 - DNA, 76 bp, Artificial Sequence
  Synthetic oligonucleotide
cttctaagccacaagcacacggggctccagcccccccgagtggaagtgctccccactttctttaggatttaggcgc

SEQ ID NO: 209 - DNA, 121 bp, Artificial Sequence
  Synthetic oligonucleotide
ccatggtacaaggaatagtcgcgcaagcatcccgctggtgcctcccgggacgaaggacttcccgagcggtgtggggaccgggctctgacagccctgcggagaccctgagtccgggaggcac

SEQ ID NO: 210 - DNA, 629 bp, Artificial Sequence
  Synthetic oligonucleotide
cgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcat

SEQ ID NO: 211 - DNA, 1615 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagacaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctctcatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 212 - DNA, 1486 bp, Homo sapiens
caaagggctcagtcccttcggggaggcttctggtgaaggaggatcgctagaaccaagctgtcctcttaagctagttgcagcagcccctcctcccagccacctccgccaatctctcactcacctttggctcctgcccttagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctctcatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 213 - DNA, 1564 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctctcatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 214 - DNA, 1458 bp, Homo sapiens
aggagatactgtagagttctgggggaggaaggaatcccaagacctgggttgtcatccaagccttgcaaacatcttggagtgagtcctggagaaatacatttaactcccagggccatggaagcagggctcagttctctctgggagctgtgaggcaaggcatttggataaatctggcctcctcatgatgccaccagcttgtcccctaagtgtgatggacatggagctggaagccaggatcaccaacactttctcttttcttccacagcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctctcatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 215 - protein, 93 aa, Homo sapiens
MIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 216 - protein, 80 aa, Homo sapiens
MMPPACPLSVMDMELEARITNTFSFLPQHRFLPCENKSKAVEQVKNAFNKLQEKGIYKAMSEFDIFINYIEAYMTMKIRN

SEQ ID NO: 217 - protein, 173 aa, Homo sapiens
MHSSALLCCLVLLTGVRASPGQGTQSENSCTHFPGNLPNMLRDLRDAFSRQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 218 - protein, 156 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLQEKGIYKAMSEFDIFINYIEAYMTMKIRN

SEQ ID NO: 219 - protein, 79 aa, Homo sapiens
MPPACPLSVMDMELEARITNTFSFLPQHRFLPCENKSKAVEQVKNAFNKLQEKGIYKAMSEFDIFINYIEAYMTMKIRN

SEQ ID NO: 220 - DNA, 209 bp, Artificial Sequence
  Synthetic oligonucleotide
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcaga

SEQ ID NO: 221 - DNA, 15 bp, Artificial Sequence
  Synthetic oligonucleotide
gtgaagactttcttt

SEQ ID NO: 222 - DNA, 60 bp, Artificial Sequence
  Synthetic oligonucleotide
caaatgaaggatcagctggacaacttgttgttaaaggagtccttgctggaggactttaag

SEQ ID NO: 223 - DNA, 140 bp, Artificial Sequence
  Synthetic oligonucleotide
caaagggctcagtcccttcggggaggcttctggtgaaggaggatcgctagaaccaagctgtcctcttaagctagttgcagcagcccctcctcccagccacctccgccaatctctcactcacctttggctcctgcccttag

SEQ ID NO: 224 - DNA, 153 bp, Artificial Sequence
  Synthetic oligonucleotide
ggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgt

SEQ ID NO: 225 - DNA, 265 bp, Artificial Sequence
  Synthetic oligonucleotide
aggagatactgtagagttctgggggaggaaggaatcccaagacctgggttgtcatccaagccttgcaaacatcttggagtgagtcctggagaaatacatttaactcccagggccatggaagcagggctcagttctctctgggagctgtgaggcaaggcatttggataaatctggcctcctcatgatgccaccagcttgtcccctaagtgtgatggacatggagctggaagccaggatcaccaacactttctcttttcttccacag

SEQ ID NO: 226 - DNA, 66 bp, Artificial Sequence
  Synthetic oligonucleotide
catcgatttcttccctgtgaaaacaagagcaaggccgtggagcaggtgaagaatgcctttaataag

SEQ ID NO: 227 - DNA, 458 bp, Artificial Sequence
  Synthetic oligonucleotide
ctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctctcatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagc

SEQ ID NO: 228 - DNA, 25 bp, Artificial Sequence
  Synthetic oligonucleotide
ctgaccacgctttctagctgttgag

SEQ ID NO: 229 - DNA, 213 bp, Artificial Sequence
  Synthetic oligonucleotide
ctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggtt

SEQ ID NO: 230 - DNA, 4 bp, Artificial Sequence
  Synthetic oligonucleotide
ctag

SEQ ID NO: 231 - DNA, 14 bp, Artificial Sequence
  Synthetic oligonucleotide
gccgggcgcggtgg

SEQ ID NO: 232 - DNA, 214 bp, Artificial Sequence
  Synthetic oligonucleotide
ctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgag

SEQ ID NO: 233 - DNA, 82 bp, Artificial Sequence
  Synthetic oligonucleotide
ctgatatcatgcccctgtactccagcctgggtgacagagcaagactctgtctcaaaaaataaaaataaaaataaatttggtt

SEQ ID NO: 234 - DNA, 117 bp, Artificial Sequence
  Synthetic oligonucleotide
ctaatagaactcagttttaactagaatttattcaattcctctgggaatgttacattgtttgtctgtcttcatagcagattttaattttgaataaataaatgtatcttattcacatca

SEQ ID NO: 235 - DNA, 1849 bp, Homo sapiens
ggctggagctcagcccagcagtggaatccaggagcccagaggtggccgggtgctgacgtgatggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgatgctgtgattgccatccagtcccagactgtgggaggctgggagtgtgagaagctttcccaaccctggcagggttgtaccatttcggcaacttccagtgcaaggacgtcctgctgcatcctcactgggtgctcactactgctcactgcatcacccggtgtggagatacgacgggattcagctgggtgcagccacatgataaaggaaggaccggagcttggtgtaacccctgatccctcctagatggggctaggtggggctagcctagatggggctaagtcctagcgacttccacctggacttgtctggtgtaacatccctcatccacaggtctggaagcccatgtggaaattctgtcactttctcagcatgcctgtcccagttatgcattattctgtaattggtgaaataccggaagggtaggttcagagacccacgggacccattgtgagatgggccttggccacaactcctgacctccaccaggcgccacactgattgttggactacagtggtgttttgggtctcttgtaattagtgtcagttaagaatcagtgtccaataatctccaaaacatctggtaactgactcaagtttatgaattgaacgatgggccaggattctttgcttttatgattcaaattatacttctgttcactggacccaagaagtcttctgattacatagaaataatttagtcttttccaatctatttctcttccaggaacactgtgatcaactagccagcaccatagttctccgaagtcagactatcatgattactgtgttgactgtgctgtctattgtactaaccatgccgatgtttaggtgaaattagcgtcacttggcctcaaccatcttggtatccagttatcctcactgaattgagatttcctgcttcagtgtcagccattcccacataatttctgacctacagaggtgagggatcatatagctcttcaaggatgctggtactcccctcacaaattcatttctcctgttgtagtgaaaggtgcgccctctggagcctcccagggtgggtgtgcaggtcacaatgatgaatgtatgatcgtgttcccattacccaaagcctttaaatccctcatgctcagtacaccagggcaggtctagcatttcttcatttagtgtatgctgtccattcatgcaaccacctcaggactcctggattctctgcctagttgagctcctgcatgctgcctccttggggaggtgagggagagggcccatggttcaatgggatctgtgcagttgtaacacattaggtgcttaataaacagaagctgtgatgttaacc

SEQ ID NO: 236 - protein, 238 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANDAVIAIQSQTVGGWECEKLSQPWQGCTISATSSARTSCCILTGCSLLLTASPGVEIRRDSAGCSHMIKEGPELGVTPDPS

SEQ ID NO: 237 - DNA, 49 bp, Artificial Sequence
  Synthetic oligonucleotide
ggctggagctcagcccagcagtggaatccaggagcccagaggtggccgg

SEQ ID NO: 238 - DNA, 72 bp, Artificial Sequence
  Synthetic oligonucleotide
gtgctgacgtgatggccacagcaggaaatccctggggctggttcctggggtacctcatccttggtgtcgcag

SEQ ID NO: 239 - DNA, 163 bp, Artificial Sequence
  Synthetic oligonucleotide
gatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaa

SEQ ID NO: 240 - DNA, 251 bp, Artificial Sequence
  Synthetic oligonucleotide
ctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacg

SEQ ID NO: 241 - DNA, 156 bp, Artificial Sequence
  Synthetic oligonucleotide
atgctgtgattgccatccagtcccagactgtgggaggctgggagtgtgagaagctttcccaaccctggcagggttgtaccatttcggcaacttccagtgcaaggacgtcctgctgcatcctcactgggtgctcactactgctcactgcatcacccg

SEQ ID NO: 242 - DNA, 567 bp, Artificial Sequence
  Synthetic oligonucleotide
gtgtggagatacgacgggattcagctgggtgcagccacatgataaaggaaggaccggagcttggtgtaacccctgatccctcctagatggggctaggtggggctagcctagatggggctaagtcctagcgacttccacctggacttgtctggtgtaacatccctcatccacaggtctggaagcccatgtggaaattctgtcactttctcagcatgcctgtcccagttatgcattattctgtaattggtgaaataccggaagggtaggttcagagacccacgggacccattgtgagatgggccttggccacaactcctgacctccaccaggcgccacactgattgttggactacagtggtgttttgggtctcttgtaattagtgtcagttaagaatcagtgtccaataatctccaaaacatctggtaactgactcaagtttatgaattgaacgatgggccaggattctttgcttttatgattcaaattatacttctgttcactggacccaagaagtcttctgattacatagaaataatttagtcttttccaatctatttctcttccag

SEQ ID NO: 243 - DNA, 591 bp, Artificial Sequence
  Synthetic oligonucleotide
gaacactgtgatcaactagccagcaccatagttctccgaagtcagactatcatgattactgtgttgactgtgctgtctattgtactaaccatgccgatgtttaggtgaaattagcgtcacttggcctcaaccatcttggtatccagttatcctcactgaattgagatttcctgcttcagtgtcagccattcccacataatttctgacctacagaggtgagggatcatatagctcttcaaggatgctggtactcccctcacaaattcatttctcctgttgtagtgaaaggtgcgccctctggagcctcccagggtgggtgtgcaggtcacaatgatgaatgtatgatcgtgttcccattacccaaagcctttaaatccctcatgctcagtacaccagggcaggtctagcatttcttcatttagtgtatgctgtccattcatgcaaccacctcaggactcctggattctctgcctagttgagctcctgcatgctgcctccttggggaggtgagggagagggcccatggttcaatgggatctgtgcagttgtaacacattaggtgcttaataaacagaagctgtgatgttaacc

SEQ ID NO: 244 - DNA, 755 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagtt

SEQ ID NO: 245 - protein, 137 aa, Homo sapiens
MAARALCMLGLVLALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 246 - DNA, 359 bp, Artificial Sequence
  Synthetic oligonucleotide
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgt

SEQ ID NO: 247 - DNA, 44 bp, Artificial Sequence
  Synthetic oligonucleotide
cccagcaagggctctggcagctgacagggctttgtctgggacag

SEQ ID NO: 248 - DNA, 97 bp, Artificial Sequence
  Synthetic oligonucleotide
ctgcaaaccagtgtgccgtgccagccaaggacagggtggactgcggctacccccatgtcacccccaaggagtgcaacaaccggggctgctgctttga

SEQ ID NO: 249 - DNA, 50 bp, Artificial Sequence
  Synthetic oligonucleotide
ctccaggatccctggagtgccttggtgtttcaagcccctgcaggaagcag

SEQ ID NO: 250 - DNA, 19 bp, Artificial Sequence
  Synthetic oligonucleotide
aatgcaccttctgaggcac

SEQ ID NO: 251 - DNA, 584 bp, Artificial Sequence
  Synthetic oligonucleotide
ctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggca

SEQ ID NO: 252 - DNA, 2664 bp, Homo sapiens
gactcccaccttgggcctctgccagcctggcactgatagccacaggcagagctgagacaaaagagaggggccctggggagtatcagcagcagccaatcccggaagacatctatgtcaggtggtttctggaaatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaaa

SEQ ID NO: 253 - DNA, 2153 bp, Homo sapiens
gactcccaccttgggcctctgccagcctggcactgatagccacaggcagagctgagacaaaagagaggggccctggggagtatcagcagcagccaatcccggaagacatctatgtcaggtggtttctggaaatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaaa

SEQ ID NO: 254 - protein, 156 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGAPTPWTSPGSSRRPLARSLTASGAATCPSA

SEQ ID NO: 255 - protein, 205 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGTSTPEGLTSPCRQSSASTSWPLPMGPGSCRATAQASLPSSSPRTPRSRCPWTCMPMQWPQGTPCWRSSAYSSWPGTSRP

SEQ ID NO: 256 - DNA, 233 bp, Artificial Sequence
  Synthetic oligonucleotide
gactcccaccttgggcctctgccagcctggcactgatagccacaggcagagctgagacaaaagagaggggccctggggagtatcagcagcagccaatcccggaagacatctatgtcaggtggtttctggaaatcgaaagtagactcttttctgaagcatttcctgggatcagcctgaccacgctccatactgggagaggcttctgggtcaaaggaccagtctgcagagggatc

SEQ ID NO: 257 - DNA, 6 bp, Artificial Sequence
  Synthetic oligonucleotide
ctgtgg

SEQ ID NO: 258 - DNA, 23 bp, Artificial Sequence
  Synthetic oligonucleotide
ctggaagcgaggaggctccacac

SEQ ID NO: 259 - DNA, 24 bp, Artificial Sequence
  Synthetic oligonucleotide
ggccgttgcagctaccgcagccag

SEQ ID NO: 260 - DNA, 19 bp, Artificial Sequence
  Synthetic oligonucleotide
gatctgggcatccaggcac

SEQ ID NO: 261 - DNA, 56 bp, Artificial Sequence
  Synthetic oligonucleotide
ggccatgacccctccgaggctcttctgggtgtggctgctggttgcaggaacccaag

SEQ ID NO: 262 - DNA, 47 bp, Artificial Sequence
  Synthetic oligonucleotide
gcgtgaacgatggtgacatgcggctggccgatgggggcgccaccaac

SEQ ID NO: 263 - DNA, 40 bp, Artificial Sequence
  Synthetic oligonucleotide
cagggccgcgtggagatcttctacagaggccagtggggca

SEQ ID NO: 264 - DNA, 6 bp, Artificial Sequence
  Synthetic oligonucleotide
ctgtgt

SEQ ID NO: 265 - DNA, 35 bp, Artificial Sequence
  Synthetic oligonucleotide
gtgacaacctgtgggacctgactgatgccagcgtc

SEQ ID NO: 266 - DNA, 64 bp, Artificial Sequence
  Synthetic oligonucleotide
gtctgccgggccctgggcttcgagaacgccacccaggctctgggcagagctgccttcgggcaag

SEQ ID NO: 267 - DNA, 71 bp, Artificial Sequence
  Synthetic oligonucleotide
gatcaggccccatcatgctggacgaggtccagtgcacgggaaccgaggcctcactggccgactgcaagtcc

SEQ ID NO: 268 - DNA, 61 bp, Artificial Sequence
  Synthetic oligonucleotide
ctgggctggctgaagagcaactgcaggcacgagagagacgctggtgtggtctgcaccaatg

SEQ ID NO: 269 - DNA, 19 bp, Artificial Sequence
  Synthetic oligonucleotide
gagcacccacaccctggac

SEQ ID NO: 270 - DNA, 48 bp, Artificial Sequence
  Synthetic oligonucleotide
ctctccagggagctctcggaggcccttggccagatctttgacagccag

SEQ ID NO: 271 - DNA, 23 bp, Artificial Sequence
  Synthetic oligonucleotide
cggggctgcgacctgtccatcag

SEQ ID NO: 272 - DNA, 79 bp, Artificial Sequence
  Synthetic oligonucleotide
cgtgaatgtgcagggcgaggacgccctgggcttctgtggccacacggtcatcctgactgccaacctggaggcccaggcc

SEQ ID NO: 273 - DNA, 77 bp, Artificial Sequence
  Synthetic oligonucleotide
ctgtggaaggagccgggcagcaatgtcaccatgagtgtggatgctgagtgtgtgcccatggtcagggaccttctcag

SEQ ID NO: 274 - DNA, 265 bp, Artificial Sequence
  Synthetic oligonucleotide
gtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccag

SEQ ID NO: 275 - DNA, 76 bp, Artificial Sequence
  Synthetic oligonucleotide
gtacttctactcccgaaggattgacatcaccctgtcgtcagtcaagtgcttccacaagctggcctctgcctatggg

SEQ ID NO: 276 - DNA, 81 bp, Artificial Sequence
  Synthetic oligonucleotide
gccaggcagctgcagggctactgcgcaagcctctttgccatcctcctcccccaggacccctcgttccagatgcccctggac

SEQ ID NO: 277 - DNA, 33 bp, Artificial Sequence
  Synthetic oligonucleotide
ctgtatgcctatgcagtggccacaggggacgcc

SEQ ID NO: 278 - DNA, 12 bp, Artificial Sequence
  Synthetic oligonucleotide
ctgctggagaag

SEQ ID NO: 279 - DNA, 133 bp, Artificial Sequence
  Synthetic oligonucleotide
ctctgcctacagttcctggcctggaacttcgaggccttgacgcaggccgaggcctggcccagtgtccccacagacctgctccaactgctgctgcccaggagcgacctggcggtgcccagcgagctggccctac

SEQ ID NO: 280 - DNA, 255 bp, Artificial Sequence
  Synthetic oligonucleotide
tgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagcccc

SEQ ID NO: 281 - DNA, 10 bp, Artificial Sequence
  Synthetic oligonucleotide
ggatttacac

SEQ ID NO: 282 - DNA, 9 bp, Artificial Sequence
  Synthetic oligonucleotide
ctcgcccac

SEQ ID NO: 283 - DNA, 38 bp, Artificial Sequence
  Synthetic oligonucleotide
ctggagtgcctttgtgacagacagttcctggagtgcac

SEQ ID NO: 284 - DNA, 117 bp, Artificial Sequence
  Synthetic oligonucleotide
ggaagtcacaactggtctatcagtccagacgggggcctttggtcaaatattcttctgattacttccaagccccctctgactacagatactacccctaccagtccttccagactccac

SEQ ID NO: 285 - DNA, 16 bp, Artificial Sequence
  Synthetic oligonucleotide
aacaccccagcttcct

SEQ ID NO: 286 - DNA, 49 bp, Artificial Sequence
  Synthetic oligonucleotide
cttccaggacaagagggtgtcctggtccctggtctacctccccaccatc

SEQ ID NO: 287 - DNA, 9 bp, Artificial Sequence
  Synthetic oligonucleotide
cagagctgc

SEQ ID NO: 288 - DNA, 17 bp, Artificial Sequence
  Synthetic oligonucleotide
tggaactacggcttctc

SEQ ID NO: 289 - DNA, 20 bp, Artificial Sequence
  Synthetic oligonucleotide
ctgctcctcggacgagctcc

SEQ ID NO: 290 - DNA, 95 bp, Artificial Sequence
  Synthetic oligonucleotide
ctgtcctgggcctcaccaagtctggcggctcagatcgcaccattgcctacgaaaacaaagccctgatgctctgcgaagggctcttcgtggcagac

SEQ ID NO: 291 - DNA, 5 bp, Artificial Sequence
  Synthetic oligonucleotide
gtcac

SEQ ID NO: 292 - DNA, 45 bp, Artificial Sequence
  Synthetic oligonucleotide
cgatttcgagggctggaaggctgcgattcccagtgccctggacac

SEQ ID NO: 293 - DNA, 18 bp, Artificial Sequence
  Synthetic oligonucleotide
caacagctcgaagagcac

SEQ ID NO: 294 - DNA, 10 bp, Artificial Sequence
  Synthetic oligonucleotide
ctcctccttc

SEQ ID NO: 295 - DNA, 2 bp, Artificial Sequence
  Synthetic oligonucleotide
cc

SEQ ID NO: 296 - DNA, 57 bp, Artificial Sequence
  Synthetic oligonucleotide
ctgcccggcagggcacttcaacggcttccgcacggtcatccgccccttctacctgac

SEQ ID NO: 297 - DNA, 6 bp, Artificial Sequence
  Synthetic oligonucleotide
caactc

SEQ ID NO: 298 - DNA, 78 bp, Artificial Sequence
  Synthetic oligonucleotide
ctcaggtgtggactagacggcgtggcccaagggtggtgagaaccggagaaccccaggacgccctcactgcaggctccc

SEQ ID NO: 299 - DNA, 8 bp, Artificial Sequence
  Synthetic oligonucleotide
ctcctcgg

SEQ ID NO: 300 - DNA, 5 bp, Artificial Sequence
  Synthetic oligonucleotide
cttcc

SEQ ID NO: 301 - DNA, 153 bp, Artificial Sequence
  Synthetic oligonucleotide
ttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggac

SEQ ID NO: 302 - DNA, 30 bp, Artificial Sequence
  Synthetic oligonucleotide
gccctcgaggttgctctgggatccccccac

SEQ ID NO: 303 - DNA, 19 bp, Artificial Sequence
  Synthetic oligonucleotide
agcccctggtcagtctgcc

SEQ ID NO: 304 - DNA, 62 bp, Artificial Sequence
  Synthetic oligonucleotide
cttgtcactggtctgaggtcattaaaattacattgaggttcctacatttgtttgtacagaaa

SEQ ID NO: 305 - DNA, 2225 bp, Homo sapiens
ggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtc

SEQ ID NO: 306 - DNA, 1799 bp, Homo sapiens
ggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtc

SEQ ID NO: 307 - protein, 185 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTFLQQGCPPSPGVPTGFPGASYSATMWEFHHHRDLSGSSGSYVETRNSSP

SEQ ID NO: 308 - protein, 107 aa, Homo sapiens [sequence omitted]

SEQ ID NO: 309 - DNA, 79 bp, Artificial Sequence
  Synthetic oligonucleotide
ggggagggataggacagacagacaaagaaaggggtgcggcagcactgccaggggaagagggtgatccgacccggggaag

SEQ ID NO: 310 - DNA, 74 bp, Artificial Sequence
  Synthetic oligonucleotide
gtcgctgggcagggcgagttgggaaagcggcagcccccgccgcccccgcagccccttctcctcctttctcccac

SEQ ID NO: 311 - DNA, 28 bp, Artificial Sequence
  Synthetic oligonucleotide
gtcctatctgcctctcgctggaggccag

SEQ ID NO: 312 - DNA, 78 bp, Artificial Sequence
  Synthetic oligonucleotide
gccgtgcagcatcgaagacaggaggaactggagcctcattggccggcccggggcgccggcctcgggcttaaataggag

SEQ ID NO: 313 - DNA, 27 bp, Artificial Sequence
  Synthetic oligonucleotide
ctccgggctctggctgggacccgaccg

SEQ ID NO: 314 - DNA, 31 bp, Artificial Sequence
  Synthetic oligonucleotide
ctgccggccgcgctcccgctgctcctgccgg

SEQ ID NO: 315 - DNA, 84 bp, Artificial Sequence
  Synthetic oligonucleotide
gtgatggaaaaccccagcccggccgccgccctgggcaaggccctctgcgctctcctcctggccactctcggcgccgccggccag

SEQ ID NO: 316 - DNA, 34 bp, Artificial Sequence
  Synthetic oligonucleotide
cctcttgggggagagtccatctgttccgccagag

SEQ ID NO: 317 - DNA, 22 bp, Artificial Sequence
  Synthetic oligonucleotide
ccccggccaaatacagcatcac

SEQ ID NO: 318 - DNA, 79 bp, Artificial Sequence
  Synthetic oligonucleotide
cttcacgggcaagtggagccagacggccttccccaagcagtaccccctgttccgcccccctgcgcagtggtcttcgctg

SEQ ID NO: 319 - DNA, 4 bp, Artificial Sequence
  Synthetic oligonucleotide
ctgg

SEQ ID NO: 320 - DNA, 365 bp, Artificial Sequence
  Synthetic oligonucleotide
gtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcag

SEQ ID NO: 321 - DNA, 62 bp, Artificial Sequence
  Synthetic oligonucleotide
gggccgcgcatagctccgactacagcatgtggaggaagaaccagtacgtcagtaacgggctg

SEQ ID NO: 322 - DNA, 118 bp, Artificial Sequence
  Synthetic oligonucleotide
cgcgactttgcggagcgcggcgaggcctgggcgctgatgaaggagatcgaggcggcgggggaggcgctgcagagcgtgcacgcggtgttttcggcgcccgccgtccccagcggcaccg

SEQ ID NO: 323 - DNA, 7 bp, Artificial Sequence
  Synthetic oligonucleotide
ggcagac

SEQ ID NO: 324 - DNA, 37 bp, Artificial Sequence
  Synthetic oligonucleotide
gtcggcggagctggaggtgcagcgcaggcactcgctg

SEQ ID NO: 325 - DNA, 143 bp, Artificial Sequence
  Synthetic oligonucleotide
gtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcac

SEQ ID NO: 326 - DNA, 49 bp, Artificial Sequence
  Synthetic oligonucleotide
cttctcctcccccaacttcgccaccatcccgcaggacacggtgaccgag

SEQ ID NO: 327 - DNA, 175 bp, Artificial Sequence
  Synthetic oligonucleotide
ataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcag

SEQ ID NO: 328 - DNA, 343 bp, Artificial Sequence
  Synthetic oligonucleotide
ctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccag

SEQ ID NO: 329 - DNA, 52 bp, Artificial Sequence
  Synthetic oligonucleotide
ttccagaaacgccgctggactgcgaggtctccctgtggtcgtcctggggact

SEQ ID NO: 330 - DNA, 100 bp, Artificial Sequence
  Synthetic oligonucleotide
gtgcggaggccactgtgggaggctcgggaccaagagcaggactcgctacgtccgggtccagcccgccaacaacgggagcccctgccccgagctcgaagaa

SEQ ID NO: 331 - DNA, 38 bp, Artificial Sequence
  Synthetic oligonucleotide
gaggctgagtgcgtccctgataactgcgtctaagacca

SEQ ID NO: 332 - DNA, 113 bp, Artificial Sequence
  Synthetic oligonucleotide
gagccccgcagcccctggggccccccggagccatggggtgtcgggggctcctgtgcaggctcatgctgcaggcggccgagggcacagggggtttcgcgctgctcctgaccgcg

SEQ ID NO: 333 - DNA, 5 bp, Artificial Sequence
  Synthetic oligonucleotide
gtgag

SEQ ID NO: 334 - DNA, 27 bp, Artificial Sequence
  Synthetic oligonucleotide
gccgcgccgaccatctctgcactgaag

SEQ ID NO: 335 - DNA, 36 bp, Artificial Sequence
  Synthetic oligonucleotide
ggccctctggtggccggcacgggcattgggaaacag

SEQ ID NO: 336 - DNA, 7 bp, Artificial Sequence
  Synthetic oligonucleotide
cctcctc

SEQ ID NO: 337 - DNA, 22 bp, Artificial Sequence
  Synthetic oligonucleotide
ctttcccaaccttgcttcttag

SEQ ID NO: 338 - DNA, 68 bp, Artificial Sequence
  Synthetic oligonucleotide
gggcccccgtgtcccgtctgctctcagcctcctcctcctgcaggataaagtcatccccaaggctccag

SEQ ID NO: 339 - DNA, 261 bp, Artificial Sequence
  Synthetic oligonucleotide
ctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtc

SEQ ID NO: 340 - DNA, 1282 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaca

SEQ ID NO: 341 - DNA, 696 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaagaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaca

SEQ ID NO: 342 - DNA, 695 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaac

SEQ ID NO: 343 - DNA, 885 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaac

SEQ ID NO: 344 - DNA, 550 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaca

SEQ ID NO: 345 - protein, 139 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGKQGMRAH

SEQ ID NO: 346 - protein, 190 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGCFSPSISPSHFFTMSSISTFSAVLRTSASSLSACVLPATHQMRSGEEFSTFGFMLVLK

SEQ ID NO: 347 - protein, 156 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGEKRHHKQLRDQEVDPLEMRRHSAG

SEQ ID NO: 348 - protein, 89 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPRGSLGSAQ

SEQ ID NO: 349 - protein, 82 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPT

SEQ ID NO: 350 - DNA, 208 bp, Artificial Sequence
  Synthetic oligonucleotide
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagt

SEQ ID NO: 351 - DNA, 37 bp, Artificial Sequence
  Synthetic oligonucleotide
ccttcaaagctggagtctgtcctcctaagaaatctgc

SEQ ID NO: 352 - DNA, 122 bp, Artificial Sequence
  Synthetic oligonucleotide
ccagtgccttagatacaagaaacctgagtgccagagtgactggcagtgtccagggaagaagagatgttgtcctgacacttgtggcatcaaatgcctggatcctgttgacaccccaaacccaa

SEQ ID NO: 353 - DNA, 4 bp, Artificial Sequence
  Synthetic oligonucleotide
caag

SEQ ID NO: 354 - DNA, 146 bp, Artificial Sequence
  Synthetic oligonucleotide
gaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaag

SEQ ID NO: 355 - DNA, 582 bp, Artificial Sequence
  Synthetic oligonucleotide
gtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacag

SEQ ID NO: 356 - DNA, 183 bp, Artificial Sequence
  Synthetic oligonucleotide
cttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaca

SEQ ID NO: 357 - DNA, 190 bp, Artificial Sequence
  Synthetic oligonucleotide
gtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacag

SEQ ID NO: 358 - DNA, 178 bp, Artificial Sequence
  Synthetic oligonucleotide
gctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaac

SEQ ID NO: 359 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLLIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 360 - protein, 687 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 361 - DNA, 21 bp, Homo sapiens
gcatagttcagcgttgccaac

SEQ ID NO: 362 - DNA, 20 bp, Homo sapiens
ccatggccaagctgtattca

SEQ ID NO: 363 - DNA, 127 bp, Homo sapiens
gcatagttcagcgttgccaactcatgctatgctttctaatcattgtagatgtctgtgttctctaaataagtcagttttctgttggccaagagttacattatcatgaatgaatacagcttggccatgg

SEQ ID NO: 364 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 365 - DNA, 86 bp, Artificial Sequence
  Synthetic oligonucleotide
tgggaacaagagggcatctgctaaagtttcagattccatttctgctcagtatccagtagtggatcatgaatttgatgcagtggtgg

SEQ ID NO: 366 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 367 - DNA, 133 bp, Artificial Sequence
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 368 - DNA, 101 bp, Artificial Sequence
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 369 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 370 - DNA, 122 bp, Artificial Sequence
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 371 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 372 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 373 - protein, 159 aa, Homo sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 374 - protein, 180 aa, Homo sapiens
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 375 - protein, 143 aa, Homo sapiens
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 376 - DNA, 139 bp, Homo sapiens
tgctgactcaaaggggggattataaaactaatcatcaaagccaagaaggcaagagcaagcatgtaccgctgaaaacacaagataactgcataagtaatgactttcagtgcagattcatagctaacccataaactgctgg

SEQ ID NO: 377 - DNA, 19 bp, Homo sapiens
tgctgactcaaagggggga

SEQ ID NO: 378 - DNA, 24 bp, Homo sapiens
ccagcagtttatgggttagctatg

SEQ ID NO: 379 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 380 - DNA, 94 bp, Artificial Sequence
  Synthetic oligonucleotide
tgacactggcaaaacaatgcagactttgctttccttggtcaggcagtataatccaaagatggtcaaggtcgcaagcttgctggtgaaaaggacc

SEQ ID NO: 381 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 382 - DNA, 91 bp, Artificial Sequence
  Synthetic oligonucleotide
tgagagtgattcgcgtgggtacccgcaagagccagcttgctcgcatacagacggacagtgtggtggcaacattgaaagcctcgtaccctgg

SEQ ID NO: 383 - DNA, 103 bp, Homo sapiens
aggaccaaatgtcaatttagaagatagatgtggtacccattgagcctcatgctctgttcttgggaatccatggagggaagatgtgcctgtcctgtgtcaagtc

SEQ ID NO: 384 - DNA, 28 bp, Homo sapiens
aggaccaaatgtcaatttagaagataga

SEQ ID NO: 385 - DNA, 22 bp, Homo sapiens
gacttgacacaggacaggcaca

SEQ ID NO: 386 - DNA, 101 bp, Homo sapiens
caaccaactagttgctggatacttgcaaggaccaaatgtcaatttagaaggtgagtggttgccaggaaagccaatgtatgtgggcatcacgtcactttgcc

SEQ ID NO: 387 - DNA, 25 bp, Homo sapiens
caaccaactagttgctggatacttg

SEQ ID NO: 388 - DNA, 19 bp, Homo sapiens
ggcaaagtgacgtgatgcc

SEQ ID NO: 389 - DNA, 108 bp, Homo sapiens
gagcgagaacagaaagcaggacaagcgcttcgccttcatccgctcagacagtggccccaccaccagttttgagtctgccgcctgccccggttggttcctctgcacagc

SEQ ID NO: 390 - DNA, 21 bp, Homo sapiens
gagcgagaacagaaagcagga

SEQ ID NO: 391 - DNA, 20 bp, Homo sapiens
gctgtgcagaggaaccaacc

SEQ ID NO: 392 - protein, 221 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 393 - DNA, 101 bp, Homo sapiens
tcgtgtccgagtaccccagcgaggtggagcacatgttcagcccatcctgtgtctccctgctgcgctgcaccggctgctgcggcgatgagaatctgcactgt

SEQ ID NO: 394 - DNA, 19 bp, Homo sapiens
tcgtgtccgagtaccccag

SEQ ID NO: 395 - DNA, 21 bp, Homo sapiens
acagtgcagattctcatcgcc

SEQ ID NO: 396 - DNA, 98 bp, Homo sapiens
tggtttggctggggctcggggctattctcgggcctgccagcctctgtcctagcatggggttccccagccaccttgtcctgacgcttggcttattgcag

SEQ ID NO: 397 - DNA, 17 bp, Homo sapiens
tggtttggctggggctc

SEQ ID NO: 398 - DNA, 21 bp, Homo sapiens
ctgcaataagccaagcgtcag

SEQ ID NO: 399 - DNA, 109 bp, Homo sapiens
cttgtcctgacgcttggcttattgcaggaggagacccaagggcagggggaagaggaggagagagaagcagagacccacagactgccacctgtgcggcgatgctgttccc

SEQ ID NO: 400 - DNA, 21 bp, Homo sapiens
cttgtcctgacgcttggctta

SEQ ID NO: 401 - DNA, 16 bp, Homo sapiens
gggaacagcatcgccg

SEQ ID NO: 402 - DNA, 101 bp, Artificial Sequence
  Synthetic oligonucleotide
ctggcaagcagctggaagatggacgtactttgtctgactacaatattcaaaaggagtctactcttcatcttgtgttgagacttcgtggtggtgctaagaaa

SEQ ID NO: 403 - DNA, 541 bp, Homo sapiens
cttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaca

SEQ ID NO: 404 - DNA, 111 bp, Artificial Sequence
  Synthetic oligonucleotide
gaggccgtcaccaagaacattcacgagtcctgcatgagccagataggctggaaccgcatcatcgtggagaagcccttcgggagggacctgcagagctctgaccggctgtcc

SEQ ID NO: 405 - DNA, 2395 bp, Homo sapiens
agaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcc

SEQ ID NO: 406 - protein, 381 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 407 - DNA, 113 bp, Artificial Sequence
  Synthetic oligonucleotide
cccactgccccctccttagcccaatgcctgctctcctcctccccctaccctgccactgcatgaccctctccctctgtggtcccactgcaatgcaccaaggaggacagaaacca

SEQ ID NO: 408 - DNA, 17 bp, Homo sapiens
cccactgccccctcctt

SEQ ID NO: 409 - DNA, 21 bp, Homo sapiens
tggtttctgtcctccttggtg

SEQ ID NO: 410 - DNA, 94 bp, Artificial Sequence
  Synthetic oligonucleotide
gagaatggctgccgcgagactctgagtgccacctctgcagtccgtgaccacccaggccgggaacagcagcgagcaggccataccacaggcaatg

SEQ ID NO: 411 - DNA, 16 bp, Homo sapiens
gagaatggctgccgcg

SEQ ID NO: 412 - DNA, 20 bp, Homo sapiens
cattgcctgtggtatggcct

SEQ ID NO: 413 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 414 - DNA, 162 bp, Artificial Sequence
  Synthetic oligonucleotide
tggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaag

SEQ ID NO: 415 - DNA, 20 bp, Homo sapiens
tggtttccgtcgccctgatg

SEQ ID NO: 416 - DNA, 22 bp, Homo sapiens
cttcgggaccaacggtcagttc

SEQ ID NO: 417 - DNA, 115 bp, Artificial Sequence
  Synthetic oligonucleotide
acgggagggaaggaaggtgtgcgggaggagttctctgtctccactcccctggcccgggggatcgtcggggctggaccgcagctcagatggcgcgagcagtttccagctccctctg

SEQ ID NO: 418 - DNA, 19 bp, Homo sapiens
acgggagggaaggaaggtg

SEQ ID NO: 419 - DNA, 20 bp, Homo sapiens
cagagggagctggaaactgc

SEQ ID NO: 420 - DNA, 101 bp, Artificial Sequence
  Synthetic oligonucleotide
tgcacggtgcagaagctggcacaccagatctaccagttcacagataaggacaaggacaacgtcgcccccaggagcaagatcagcccccagggctacggccg

SEQ ID NO: 421 - DNA, 18 bp, Homo sapiens
tgcacggtgcagaagctg

SEQ ID NO: 422 - DNA, 15 bp, Homo sapiens
cggccgtagccctgg

SEQ ID NO: 423 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 424 - DNA, 91 bp, Artificial Sequence
  Synthetic oligonucleotide
tctggtgaaggaggatcgctagaaccaagctgtcctcttaagctagttgcagcagcccctcctcccagccacctccgccaatctctcactc

SEQ ID NO: 425 - DNA, 20 bp, Homo sapiens
tctggtgaaggaggatcgct

SEQ ID NO: 426 - DNA, 21 bp, Homo sapiens
gagtgagagattggcggaggt

SEQ ID NO: 427 - DNA, 136 bp, Artificial Sequence
  Synthetic oligonucleotide
aagaaggcatgcacagctcagcactgctctgttgcctggtcctcctgactggggtgagggccagcccaggccagggcacccagtctgagaacagctgcacccacttcccaggcaacctgcctaacatgcttcgaga

SEQ ID NO: 428 - DNA, 21 bp, Homo sapiens
aagaaggcatgcacagctcag

SEQ ID NO: 429 - DNA, 21 bp, Homo sapiens
tctcgaagcatgttaggcagg

SEQ ID NO: 430 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 431 - DNA, 101 bp, Artificial Sequence
  Synthetic oligonucleotide
ctgctggcgaacgatgctgtgattgccatccagtcccagactgtgggaggctgggagtgtgagaagctttcccaaccctggcagggttgtaccatttcggc

SEQ ID NO: 432 - DNA, 18 bp, Homo sapiens
ctgctggcgaacgatgct

SEQ ID NO: 433 - DNA, 20 bp, Homo sapiens
gccgaaatggtacaaccctg

SEQ ID NO: 434 - DNA, 101 bp, Artificial Sequence
  Synthetic oligonucleotide
aatgcctaccgtgctgcagtgcgtgaacgtgtcggtggtgtctgaggaggtctgcagtaagctctatgacccgctgtaccaccccagcatgttctgcgccg

SEQ ID NO: 435 - DNA, 19 bp, Homo sapiens
aatgcctaccgtgctgcag

SEQ ID NO: 436 - DNA, 17 bp, Homo sapiens
cggcgcagaacatgctg

SEQ ID NO: 437 - DNA, 118 bp, Artificial Sequence
  Synthetic oligonucleotide
ctgggtgcagccacatgataaaggaaggaccggagcttggtgtaacccctgatccctcctagatggggctaggtggggctagcctagatggggctaagtcctagcgacttccacctgg

SEQ ID NO: 438 - DNA, 20 bp, Homo sapiens
ctgggtgcagccacatgata

SEQ ID NO: 439 - DNA, 20 bp, Homo sapiens
ccaggtggaagtcgctagga

SEQ ID NO: 440 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 441 - protein, 585 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 442 - protein, 331 aa, Homo sapiens [sequence omitted]

SEQ ID NO: 443 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 444 - DNA, 101 bp, Artificial Sequence
  Synthetic oligonucleotide
accccaaacccaacttgattcctgccatatggaggaggctctggagtcctgctctgtgtggtccaggtcctttccaccctgagacttggctccaccactga

SEQ ID NO: 445 - DNA, 21 bp, Homo sapiens
accccaaacccaacttgattc

SEQ ID NO: 446 - DNA, 21 bp, Homo sapiens
tcagtggtggagccaagtctc

SEQ ID NO: 447 - DNA, 101 bp, Artificial Sequence
  Synthetic oligonucleotide
aagaaatctgcccagtgccttagatacaagaaacctgagtgccagagtgactggcagtgtccagggaagaagagatgttgtcctgacacttgtggcatcaa

SEQ ID NO: 448 - DNA, 20 bp, Homo sapiens
aagaaatctgcccagtgcct

SEQ ID NO: 449 - DNA, 21 bp, Homo sapiens
ttgatgccacaagtgtcagga

SEQ ID NO: 450 - DNA, 116 bp, Artificial Sequence
  Synthetic oligonucleotide
tgcaccaccaactgcttagcacccctggccaaggtcatccatgacaactttggtatcgtggaaggactcatgaccacagtccatgccatcactgccacccagaagactgtggatgg

SEQ ID NO: 451 - DNA, 1261 bp, Homo sapiens
cttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaa

SEQ ID NO: 452 - DNA, 101 bp, Artificial Sequence
  Synthetic oligonucleotide
ctcctgaaccctactccaagcacagcctctgtctgactcccttgtccttcaagagaactgttctccaggtctcagggccaggatttccataggatcgcctg

SEQ ID NO: 453 - DNA, 22 bp, Homo sapiens
ctcctgaaccctactccaagca

SEQ ID NO: 454 - DNA, 21 bp, Homo sapiens
caggcgatcctatggaaatcc

SEQ ID NO: 455 - DNA, 113 bp, Artificial Sequence
  Synthetic oligonucleotide
caagcaattgagggaccaggaagtggatcctctagagatgaggaggcattctgctggatgacttttaaaaatgttttctccagagtcatctctctcattaacaatgttttttg

SEQ ID NO: 456 - DNA, 20 bp, Homo sapiens
caagcaattgagggaccagg

SEQ ID NO: 457 - DNA, 29 bp, Homo sapiens
caaaaaacattgttaatgagagagatgac

SEQ ID NO: 458 - DNA, 50 bp, Homo sapiens
aactctggcaccttgggctgtggaaggctctggaaagtccttcaaagctg

SEQ ID NO: 459 - protein, 4 aa, Artificial Sequence
  Synthetic peptide
MTAP

SEQ ID NO: 460 - protein, 682 aa, Artificial Sequence
  Synthetic peptide
DQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 461 - protein, 682 aa, Artificial Sequence; identical to SEQ ID NO: 460
  Synthetic peptide

SEQ ID NO: 462 - protein, 28 aa, Artificial Sequence
  Synthetic peptide
ELYTSTSPSSSSSSPLSSSSSSSSSSSS

SEQ ID NO: 463 - protein, 77 aa, Artificial Sequence
  Synthetic peptide
DQEAPYLLRNLSDHTVAISSSTTLDCHANGVPEPQITWFKNNHKIQQEPELYTSTSPSSSSSSPLSSSSSSSSSSSS

SEQ ID NO: 464 - protein, 12 aa, Artificial Sequence
  Synthetic peptide
SANTAVNKKTEI

SEQ ID NO: 465 - protein, 62 aa, Artificial Sequence
  Synthetic peptide
DQEAPYLLRNLSDHTVAISSSTTLDCHANGVPEPQITWFKNNHKIQQEPGSANTAVNKKTEI

SEQ ID NO: 466 - protein, 30 aa, Artificial Sequence
  Synthetic peptide
KRLFFLPFIISHLSSAPLSLNSPVTCFQYV

SEQ ID NO: 467 - protein, 80 aa, Artificial Sequence
  Synthetic peptide
DQEAPYLLRNLSDHTVAISSSTTLDCHANGVPEPQITWFKNNHKIQQEPGKRLFFLPFIISHLSSAPLSLNSPVTCFQYV

SEQ ID NO: 468 - protein, 30 aa, Artificial Sequence
  Synthetic peptide
YLDIRTEEQIFSFIQKTQTLKLTVSCKAAF

SEQ ID NO: 469 - protein, 36 aa, Artificial Sequence
  Synthetic peptide
GKHSSALPTHAMLSNHCRCLCSLNKSVFCWPRVTLS

SEQ ID NO: 470 - protein, 43 aa, Artificial Sequence
  Synthetic peptide
VNLNTAILSILSLQISIMKFYSFYLSGIISLQTPGLLSGLSCN

SEQ ID NO: 471 - protein, 54 aa, Artificial Sequence
  Synthetic peptide
GKTSIFYILFAFALQMSHKSTLIHWKGCFPSEYERNGLGKRFHPSCRHFRGCQF

SEQ ID NO: 472 - protein, 24 aa, Artificial Sequence
  Synthetic peptide
LPPANSSFMLPPTSFSSNYFHFLP

SEQ ID NO: 473 - protein, 14 aa, Artificial Sequence
  Synthetic peptide
ELSNFECLHPCSQE

SEQ ID NO: 474 - protein, 30 aa, Artificial Sequence
  Synthetic peptide
GEWLPGKPMYVGITSLCPSVCSSMACLHKP

SEQ ID NO: 475 - protein, 30 aa, Artificial Sequence; identical to SEQ ID NO: 474
  Synthetic peptide

SEQ ID NO: 476 - protein, 30 aa, Artificial Sequence; identical to SEQ ID NO: 474
  Synthetic peptide

SEQ ID NO: 477 - protein, 3 aa, Artificial Sequence
  Synthetic peptide
GGL

SEQ ID NO: 478 - protein, 6 aa, Artificial Sequence
  Synthetic peptide
DRCGTH

SEQ ID NO: 479 - protein, 6 aa, Artificial Sequence
  Synthetic peptide
DRCGTH

SEQ ID NO: 480 - protein, 63 aa, Artificial Sequence
  Synthetic peptide
SHLVLTLGLLQEETQGQGEEEEREAETHRLPPVRRCCSPEVTHPLEERDPAPGSCIYYRHTLQ

SEQ ID NO: 481 - protein, 22 aa, Artificial Sequence
  Synthetic peptide
SEPTAPSLAQCLLSSSPYPATA

SEQ ID NO: 482 - protein, 229 aa, Artificial Sequence
  Synthetic peptide
VRAASSPPACLPTQAPVPTHGEPHTQHPSQPDTHTHTHTHTAPKPARHKHTAPQPAGHTHTHTHNTPAGRTHTHTVPQLAGHTHTQHPIQTHTHTQYPSQLETHTHTALHPDTYPHSTPASQTHTHTHTHTHTQHTHSTPAGHTHTHTHPVHKGPRKLRALQPCTRPWAPRFRCTRWACTLTHPYTLTLTHMLTHLFILTYMLMLIHTQSRPPALKSPHSPIFAFCPPT

SEQ ID NO: 483 - protein, 22 aa, Artificial Sequence
  Synthetic peptide
SEPTAPSLAQCLLSSSPYPATA

SEQ ID NO: 484 - protein, 5 aa, Artificial Sequence
  Synthetic peptide
LAPVC

SEQ ID NO: 485 - protein, 73 aa, Artificial Sequence
  Synthetic peptide
VRHPGPHRAQEHTHTCSSLQLPPLSQLTPPSGPSWLPEVRRGESRLCIAPTQGTLGLRLRPGRCQAYSSCNKH

SEQ ID NO: 486 - protein, 229 aa, Artificial Sequence; identical to SEQ ID NO: 482
  Synthetic peptide

SEQ ID NO: 487 - protein, 24 aa, Artificial Sequence
  Synthetic peptide
RTSPLELGASPTHVSSTLGPLPPQ

SEQ ID NO: 488 - protein, 18 aa, Artificial Sequence
  Synthetic peptide
RRQENGCRETLSATSACP

SEQ ID NO: 489 - protein, 24 aa, Artificial Sequence
  Synthetic peptide
KKTPSFKVLQYGQTWWLTPAIPAP

SEQ ID NO: 490 - protein, 56 aa, Artificial Sequence
  Synthetic peptide
CLSSPSPRPQQSGCRPHPSQALPPEHEQLPGPPELWLPLRDVHGAEAGTPDLPVHR

SEQ ID NO: 491 - protein, 123 aa, Artificial Sequence
  Synthetic peptide
QMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 492 - protein, 101 aa, Artificial Sequence
  Synthetic peptide
QMKDQLDNLLLKESLLEDFKGYLGCQALSEMIQFYLEEVMPQAENQDPDIKAHVNSLGENLKTLRLRLRRCLQEKGIYKAMSEFDIFINYIEAYMTMKIRN

SEQ ID NO: 493 - protein, 80 aa, Artificial Sequence
  Synthetic peptide
DAVIAIQSQTVGGWECEKLSQPWQGCTISATSSARTSCCILTGCSLLLTASPGVEIRRDSAGCSHMIKEGPELGVTPDPS

SEQ ID NO: 494 - protein, 49 aa, Artificial Sequence
  Synthetic peptide
FLQQGCPPSPGVPTGFPGASYSATMWEFHHHRDLSGSSGSYVETRNSSP

SEQ ID NO: 495 - protein, 8 aa, Artificial Sequence
  Synthetic peptide
GKQGMRAH

SEQ ID NO: 496 - protein, 59 aa, Artificial Sequence
  Synthetic peptide
GCFSPSISPSHFFTMSSISTFSAVLRTSASSLSACVLPATHQMRSGEEFSTFGFMLVLK

SEQ ID NO: 497 - protein, 25 aa, Artificial Sequence
  Synthetic peptide
GEKRHHKQLRDQEVDPLEMRRHSAG

SEQ ID NO: 498 - protein, 8 aa, Artificial Sequence
  Synthetic peptide
RGSLGSAQ

SEQ ID NO: 499 - protein, 31 aa, Artificial Sequence
  Synthetic peptide
GAPTPWTSPGSSRRPLARSLTASGAATCPSA

SEQ ID NO: 500 - protein, 80 aa, Artificial Sequence
  Synthetic peptide
GTSTPEGLTSPCRQSSASTSWPLPMGPGSCRATAQASLPSSSPRTPRSRCPWTCMPMQWPQGTPCWRSSAYSSWPGTSRP

SEQ ID NO: 501 - protein, 109 aa, Artificial Sequence
  Synthetic peptide
QQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 502 - DNA, 97 bp, Homo sapiens
gatctagttcaggttcaaaattaaaagatcctgaactgagtttaaaaggcacccagcacatcatgcaagcaggccagacactgcatctccaatgcag

SEQ ID NO: 503 - DNA, 118 bp, Homo sapiens
ataaagcattcatcactgtgaaacatcgaaaacagcaggtgcttgaaaccgtagctggcaagcggtcttaccggctctctatgaaagtgaaggcatttccctcgccggaagttgtatg

SEQ ID NO: 504 - DNA, 115 bp, Homo sapiens
gtgtgacttttgttccaataatgaagagtcctttatcctggatgctgacagcaacatgggaaacagaattgagagcatcactcagcgcatggcaataatagaaggaaagaataag

SEQ ID NO: 505 - DNA, 85 bp, Homo sapiens
cttccaccagctaacagttctttcatgttgccacctacaagcttctcttccaactacttccatttccttccgtgactctaaacgg

SEQ ID NO: 506 - DNA, 109 bp, Homo sapiens
atggctagcaccttggttgtggctgactctagaatttctggaatctacatttgcatagcttccaataaagttgggactgtgggaagaaacataagcttttatatcacag

SEQ ID NO: 507 - DNA, 65 bp, Homo sapiens
aattgtcaaactttgagtgccttcatccttgctctcaggaatagaattctacctcatcggatctc

SEQ ID NO: 508 - DNA, 107 bp, Homo sapiens
gaacctcggacaagtctaatctggagctgatcactctaacatgcacctgtgtggctgcgactctcttctggctcctattaaccctctttatccgaaaaatgaaaagg

SEQ ID NO: 509 - DNA, 105 bp, Homo sapiens
gcaaatcacttggaagaggggcttttggaaaagtggttcaagcatcagcatttggcattaagaaatcacctacgtgccggactgtggctgtgaaaatgctgaaag

SEQ ID NO: 510 - DNA, 114 bp, Homo sapiens
agggggccacggccagcgagtacaaagctctgatgactgagctaaaaatcttgacccacattggccaccatctgaacgtggttaacctgctgggagcctgcaccaagcaaggag

SEQ ID NO: 511 - DNA, 89 bp, Homo sapiens
ggcctctgatggtgattgttgaatactgcaaatatggaaatctctccaactacctcaagagcaaacgtgacttattttttctcaacaag

SEQ ID NO: 512 - DNA, 33 bp, Homo sapiens
attacaaacagttacggttctaatgctttccag

SEQ ID NO: 513 - DNA, 98 bp, Homo sapiens
attctgacggtttctacaaggagcccatcactatggaagatctgatttcttacagttttcaagtggccagaggcatggagttcctgtcttccagaaag

SEQ ID NO: 514 - DNA, 112 bp, Homo sapiens
actcgacttcctctgaaatggatggctcctgaatctatctttgacaaaatctacagcaccaagagcgacgtgtggtcttacggagtattgctgtgggaaatcttctccttag

SEQ ID NO: 515 - DNA, 100 bp, Homo sapiens
gtgggtctccatacccaggagtacaaatggatgaggacttttgcagtcgcctgagggaaggcatgaggatgagagctcctgagtactctactcctgaaat

SEQ ID NO: 516 - DNA, 106 bp, Homo sapiens
ctatcagatcatgctggactgctggcacagagacccaaaagaaaggccaagatttgcagaacttgtggaaaaactaggtgatttgcttcaagcaaatgtacaacag

SEQ ID NO: 517 - DNA, 86 bp, Homo sapiens
gatggtaaagactacatcccaatcaatgccatactgacaggaaatagtgggtttacatactcaactcctgccttctctgaggactt

SEQ ID NO: 518 - DNA, 15 bp, Homo sapiens
cttcaaggaaagtat

SEQ ID NO: 519 - DNA, 42 bp, Homo sapiens
ttcagctccgaagtttaattcaggaagctctgatgatgtcag

SEQ ID NO: 520 - DNA, 85 bp, Homo sapiens
atatgtaaatgctttcaagttcatgagcctggaaagaatcaaaacctttgaagaacttttaccgaatgccacctccatgtttgat

SEQ ID NO: 521 - DNA, 95 bp, Homo sapiens
gactaccagggcgacagcagcactctgttggcctctcccatgctgaagcgcttcacctggactgacagcaaacccaaggcctcgctcaagattga

SEQ ID NO: 522 - DNA, 92 bp, Homo sapiens
cttgagagtaaccagtaaaagtaaggagtcggggctgtctgatgtcagcaggcccagtttctgccattccagctgtgggcacgtcagcgaag

SEQ ID NO: 523 - DNA, 83 bp, Homo sapiens
gcaagcgcaggttcacctacgaccacgctgagctggaaaggaaaatcgcgtgctgctccccgcccccagactacaactcggtg

SEQ ID NO: 524 - DNA, 17 bp, Homo sapiens
ttagttgtgaaagaaag

SEQ ID NO: 525 - DNA, 32 bp, Homo sapiens
ctgagaagaatgaaaatgcagtcctgaggaga

SEQ ID NO: 526 - DNA, 43 bp, Homo sapiens
ggagttttctccatatcaaaacgagggctgatggaggaaaaag

SEQ ID NO: 527 - DNA, 36 bp, Homo sapiens
ttaagcactttaagctccttgagtaaaaaggtggta

SEQ ID NO: 528 - DNA, 51 bp, Homo sapiens
gtggattgctgcttcttggggagaagagtatgcttccttttatccatgtaa

SEQ ID NO: 529 - DNA, 77 bp, Homo sapiens
tttaactgtagaacctgagctctaagtaaccgaagaatgtatgcctctgttcttatgtgccacatccttgtttaaag

SEQ ID NO: 530 - DNA, 1131 bp, Homo sapiens
gctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacatata

SEQ ID NO: 531 - protein, 1338 aa, Homo sapiens; identical to SEQ ID NO: 359

SEQ ID NO: 532 - protein, 159 aa, Homo sapiens; identical to SEQ ID NO: 373

SEQ ID NO: 533 - protein, 180 aa, Homo sapiens; identical to SEQ ID NO: 374

SEQ ID NO: 534 - protein, 177 aa, Homo sapiens; identical to SEQ ID NO: 372

SEQ ID NO: 535 - protein, 143 aa, Homo sapiens; identical to SEQ ID NO: 375

SEQ ID NO: 536 - protein, 221 aa, Homo sapiens; identical to SEQ ID NO: 392

SEQ ID NO: 537 - protein, 221 aa, Homo sapiens; identical to SEQ ID NO: 392

SEQ ID NO: 538 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 539 - protein, 381 aa, Homo sapiens; identical to SEQ ID NO: 406

SEQ ID NO: 540 - protein, 381 aa, Homo sapiens; identical to SEQ ID NO: 406

SEQ ID NO: 541 - protein, 185 aa, Homo sapiens; identical to SEQ ID NO: 413

SEQ ID NO: 542 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 543 - protein, 178 aa, Homo sapiens; identical to SEQ ID NO: 423

SEQ ID NO: 544 - protein, 178 aa, Homo sapiens; identical to SEQ ID NO: 423

SEQ ID NO: 545 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 546 - protein, 55 aa, Homo sapiens
MHSSALLCCLVLLTGVRASPGQGTQSENSCTHFPGNLPNMLRDLRDAFSRVKTFF

SEQ ID NO: 547 - protein, 159 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 548 - protein, 195 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGELTGVCLPSSRRSSAQSRGLTQSSASQAECLPCCSA

SEQ ID NO: 549 - protein, 331 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 550 - protein, 132 aa, Homo sapiens; identical to SEQ ID NO: 443

SEQ ID NO: 551 - protein, 585 aa, Homo sapiens; identical to SEQ ID NO: 441

SEQ ID NO: 552 - protein, 24 aa, Homo sapiens
LPPADSSFMLPPTSFSSNYFHFLP

SEQ ID NO: 553 - protein, 14 aa, Homo sapiens
ELSNFECLHPCSQE

SEQ ID NO: 554 - protein, 101 aa, Homo sapiens
MQERTGAATARRESLPQANNPEQLCKQRCINEASWTMKRVLSCVPEPTVVMAARALCMLGLVLALLSSSSAEEYVGLSANQCAVPAKDRVDCGYPHVTPKE

SEQ ID NO: 555 - protein, 130 aa, Homo sapiens
MQERTGAATARRESLPQANNPEQLCKQRCINEASWTMKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 556 - DNA, 20 bp, Artificial Sequence
  Synthetic oligonucleotide
tgggaacaagagggcatctg

SEQ ID NO: 557 - DNA, 22 bp, Artificial Sequence
  Synthetic oligonucleotide
ccaccactgcatcaaattcatg

SEQ ID NO: 558 - DNA, 19 bp, Artificial Sequence
  Synthetic oligonucleotide
tgagagtgattcgcgtggg

SEQ ID NO: 559 - DNA, 21 bp, Artificial Sequence
  Synthetic oligonucleotide
ccagggtacgaggctttcaat

SEQ ID NO: 560 - DNA, 21 bp, Artificial Sequence
  Synthetic oligonucleotide
tgacactggcaaaacaatgca

SEQ ID NO: 561 - DNA, 21 bp, Artificial Sequence
  Synthetic oligonucleotide
ggtccttttcaccagcaagct

SEQ ID NO: 562 - DNA, 20 bp, Artificial Sequence
  Synthetic oligonucleotide
tgcaccaccaactgcttagc

SEQ ID NO: 563 - DNA, 19 bp, Artificial Sequence
  Synthetic oligonucleotide
ccatcacgccacagtttcc

SEQ ID NO: 564 - DNA, 20 bp, Artificial Sequence
  Synthetic oligonucleotide
gaggccgtcaccaagaacat

SEQ ID NO: 565 - DNA, 19 bp, Artificial Sequence
  Synthetic oligonucleotide
ggacagccggtcagagctc

SEQ ID NO: 566 - DNA, 20 bp, Artificial Sequence
  Synthetic oligonucleotide
ctggcaagcagctggaagat

SEQ ID NO: 567 - DNA, 23 bp, Artificial Sequence
  Synthetic oligonucleotide
tttcttagcaccaccacgaagtc

SEQ ID NO: 568 - DNA, 19 bp, Artificial Sequence
  Synthetic oligonucleotide
atttgggtcgcggttcttg

SEQ ID NO: 569 - DNA, 21 bp, Artificial Sequence
  Synthetic oligonucleotide
tgccttgacattctcgatggt

SEQ ID NO: 570 - DNA, 23 bp, Artificial Sequence
  Synthetic oligonucleotide
tggcaagaagaaggtctggttag

SEQ ID NO: 571 - DNA, 22 bp, Artificial Sequence
  Synthetic oligonucleotide
tgatcagcccatctttgatgag

SEQ ID NO: 572 - DNA, 20 bp, Artificial Sequence
  Synthetic oligonucleotide
cggtttgctgcggtaatcat

SEQ ID NO: 573 - DNA, 21 bp, Artificial Sequence
  Synthetic oligonucleotide
tttcttgctgccagtctggac

SEQ ID NO: 574 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 575 - protein, 1338 aa, Homo sapiens; identical to SEQ ID NO: 574

SEQ ID NO: 576 - protein, 6 aa, Homo sapiens
MPLPFQ

SEQ ID NO: 577 - protein, 44 aa, Homo sapiens
LWAACPAQACSGNAGQERGGLQSAAGLPSQPSCFLQTGVGLANQ

SEQ ID NO: 578 - protein, 21 aa, Homo sapiens
MEICRGLRSHLITLLLFLFHS

SEQ ID NO: 579 - protein, 34 aa, Homo sapiens
MEICRGLRSHLITLLLFLFHSETICRPSGRKSSK

SEQ ID NO: 580 - protein, 3 aa, Homo sapiens
MAL

SEQ ID NO: 581 - protein, 16 aa, Homo sapiens
MALETICRPSGRKSSK

SEQ ID NO: 582 - protein, 12 aa, Homo sapiens
MHQAGYPGCRGA

SEQ ID NO: 583 - protein, 49 aa, Homo sapiens
MDEMGQVGLVGSCMCLGVLCWPLPKRTSPLELGASPTHVSSTLGPLPPQ

SEQ ID NO: 584 - protein, 28 aa, Homo sapiens
MMPPACPLSVMDMELEARITNTFSFLPQ

SEQ ID NO: 585 - protein, 29 aa, Homo sapiens
MMPPACPLSVMDMELEARITNTFSFLPQH

SEQ ID NO: 586 - protein, 18 aa, Homo sapiens
MHSSALLCCLVLLTGVRA

SEQ ID NO: 587 - protein, 27 aa, Homo sapiens
MPPACPLSVMDMELEARITNTFSFLPQ

SEQ ID NO: 588 - protein, 28 aa, Homo sapiens
MPPACPLSVMDMELEARITNTFSFLPQH

SEQ ID NO: 589 - protein, 156 aa, Homo sapiens; identical to SEQ ID NO: 254

SEQ ID NO: 590 - protein, 205 aa, Homo sapiens; identical to SEQ ID NO: 255

SEQ ID NO: 591 - protein, 82 aa, Homo sapiens
MAARALCMLGLVLALLSSSSAEEYVGLSQQGLWQLTGLCLGQLQTSVPCQPRTGWTAATPMSPPRSATTGAAALTPGSLECL

SEQ ID NO: 592 - protein, 137 aa, Homo sapiens; identical to SEQ ID NO: 245

What is claimed is:

1. A method for detecting and treating a chronic inflammation disease, wherein the chronic inflammation disease is preeclampsia, the method comprising:
   detecting a unique edge portion of the polypeptide sequence set forth in SEQ ID NO:18, the unique edge portion consisting of the amino acid sequence set forth in SEQ ID NO:462, in a test blood or serum sample from a pregnant woman, wherein said test blood or serum sample is obtained at or after the early second trimester;
   treating the pregnant woman with a therapeutic agent selected from the group consisting of COX1 and COX2 inhibitors, steroids, TNF blockers, treatments for acute coronary syndrome (ACS), and aspirin; when an altered amount of said polypeptide sequence set forth in SEQ ID NO: 18 in said test sample is detected.

2. The method of claim 1, wherein said detecting comprises detecting binding of an antibody specifically interacting with a unique edge portion of the polypeptide set forth in SEQ ID NO:18, the unique portion consisting of the amino acid sequence set forth in SEQ ID NO:462, but not with the known wild type VEGFR-1 having the amino acid sequence set forth in SEQ ID NO:359 in the blood or serum sample.

* * * * *